(12) United States Patent
Ke et al.

(10) Patent No.: US 9,657,090 B2
(45) Date of Patent: May 23, 2017

(54) METHOD OF TREATING ALVEOLAR BONE LOSS THROUGH THE USE OF ANTI-SCLEROSTIN ANTIBODIES

(71) Applicants: AMGEN, INC., Thousand Oaks, CA (US); THE REGENTS OF THE UNIVERSITY OF MICHIGAN, Ann Arbor, MI (US)

(72) Inventors: Hua Zhu Ke, Newbury Park, CA (US); Min Liu, Thousand Oaks, CA (US); William V. Giannobile, Ann Arbor, MI (US)

(73) Assignees: AMGEN INC., Thousand Oaks, CA (US); THE REGENTS OF THE UNIVERSITY OF MICHIGAN, Ann Arbor, MI (US)

( * ) Notice: Subject to any disclaimer, the term of this patent is extended or adjusted under 35 U.S.C. 154(b) by 0 days.

(21) Appl. No.: 14/362,322

(22) PCT Filed: Dec. 11, 2012

(86) PCT No.: PCT/US2012/068975
§ 371 (c)(1),
(2) Date: Jun. 2, 2014

(87) PCT Pub. No.: WO2013/101451
PCT Pub. Date: Jul. 4, 2013

(65) Prior Publication Data
US 2014/0314776 A1    Oct. 23, 2014

Related U.S. Application Data

(60) Provisional application No. 61/580,964, filed on Dec. 28, 2011.

(51) Int. Cl.
| | | |
|---|---|---|
| *A61K 39/00* | (2006.01) | |
| *A61K 39/395* | (2006.01) | |
| *A61K 47/06* | (2006.01) | |
| *C07K 16/18* | (2006.01) | |
| *C07K 16/22* | (2006.01) | |
| *A61K 45/06* | (2006.01) | |

(52) U.S. Cl.
CPC .......... *C07K 16/18* (2013.01); *A61K 39/3955* (2013.01); *A61K 45/06* (2013.01); *C07K 16/22* (2013.01); *A61K 2039/505* (2013.01); *C07K 2317/76* (2013.01)

(58) Field of Classification Search
None
See application file for complete search history.

(56) References Cited

U.S. PATENT DOCUMENTS

| | | |
|---|---|---|
| 4,331,647 A | 5/1982 | Goldenberg |
| 4,376,110 A | 3/1983 | David et al. |
| 4,411,993 A | 10/1983 | Gillis |
| 4,427,115 A | 1/1984 | Laipply |
| 4,543,439 A | 9/1985 | Frackelton, Jr. et al. |
| RE32,011 E | 10/1985 | Zimmerman et al. |
| 4,837,440 A | 6/1989 | Burtscher et al. |
| 4,902,614 A | 2/1990 | Wakabayashi et al. |
| 5,070,108 A | 12/1991 | Margolis |
| 5,145,684 A | 9/1992 | Liversidge et al. |
| 5,223,409 A | 6/1993 | Ladner et al. |
| 5,399,363 A | 3/1995 | Liversidge et al. |
| 5,453,492 A | 9/1995 | Butzow et al. |
| 5,466,468 A | 11/1995 | Schneider et al. |
| 5,543,158 A | 8/1996 | Gref et al. |
| 5,552,157 A | 9/1996 | Yagi et al. |
| 5,565,213 A | 10/1996 | Nakamori et al. |
| 5,567,434 A | 10/1996 | Szoka, Jr. |
| 5,571,714 A | 11/1996 | Dasch et al. |
| 5,627,052 A | 5/1997 | Schrader et al. |
| 5,641,515 A | 6/1997 | Ramtoola |
| 5,698,426 A | 12/1997 | Huse |
| 5,738,868 A | 4/1998 | Shinkarenko et al. |
| 5,780,263 A | 7/1998 | Hastings et al. |
| 5,795,587 A | 8/1998 | Gao et al. |
| 5,795,965 A | 8/1998 | Tsuchiya et al. |
| 5,811,238 A | 9/1998 | Stemmer et al. |
| 5,830,721 A | 11/1998 | Stemmer et al. |
| 5,837,458 A | 11/1998 | Minshull et al. |
| 5,877,397 A | 3/1999 | Lonberg et al. |
| 6,054,561 A | 4/2000 | Ring |
| 6,057,421 A | 5/2000 | Muller et al. |
| 6,117,911 A | 9/2000 | Grainger et al. |
| 6,133,426 A | 10/2000 | Gonzalez et al. |
| 6,180,370 B1 | 1/2001 | Queen et al. |
| 6,207,153 B1 | 3/2001 | Dan et al. |

(Continued)

FOREIGN PATENT DOCUMENTS

| | | |
|---|---|---|
| CN | 101287756 A | 10/2008 |
| JP | 4-141095 | 5/1992 |

(Continued)

OTHER PUBLICATIONS

A diagram of a relevant part of the human genome (D64), citation in Appeal, European Patent No. 1133558, dated Apr. 15, 2010.
Abbas et. al. (Eds.), Cellular and Molecular Immunology, Third Edition, Section II, p. 54 (1997).
Alberts et. al. (Eds.), Molecular Biology of the Cell, Third Edition, Chapter 23, p. 1212 (1994).
Albertsen et. al., A physical map and candidate genes in the BRCA1 region on chromosome 17q12-21. *Nat. Genet.*, 7:472-9 (1994).
Alting-Mees et. al., Monoclonal antibody expression libraries: A rapid alternative to hybridomas. *Strat. Molec. Biol.*, 3:1-9 (1990).
Alves et. al., Sclerosteosis: A marker of Dutch ancestry? *Rev. Bras. Genet.*, 4:825-34 (1982).

(Continued)

*Primary Examiner* — Elizabeth C Kemmerer
(74) *Attorney, Agent, or Firm* — Marshall, Gerstein & Borun LLP

(57) ABSTRACT

The invention provides a method of treating alveolar bone loss involving administration of a sclerostin inhibitor to a subject in need thereof.

16 Claims, 17 Drawing Sheets

(56) References Cited

U.S. PATENT DOCUMENTS

| | | | |
|---|---|---|---|
| 6,395,511 | B1 | 5/2002 | Brunkow et al. |
| 6,489,445 | B1 | 12/2002 | Brunkow et al. |
| 6,495,736 | B1 | 12/2002 | Galas et al. |
| 6,703,199 | B1 | 3/2004 | Koide |
| 6,803,453 | B1 | 10/2004 | Brunkow et al. |
| 6,806,055 | B2 | 10/2004 | Berman et al. |
| 6,815,201 | B2 | 11/2004 | Pinter |
| 6,818,748 | B2 | 11/2004 | Fulton et al. |
| 7,192,583 | B2 | 3/2007 | Brunkow et al. |
| 7,226,902 | B2 | 6/2007 | Winkler et al. |
| 7,381,409 | B2 | 6/2008 | Winkler et al. |
| 7,572,899 | B2 | 8/2009 | Brunkow et al. |
| 7,578,999 | B2 | 8/2009 | Winkler et al. |
| 7,592,429 | B2 | 9/2009 | Paszty et al. |
| 7,642,238 | B2 | 1/2010 | Shaughnessy |
| 7,744,874 | B2 | 6/2010 | Korytko et al. |
| 7,758,858 | B2 | 7/2010 | Brunkow et al. |
| 7,868,134 | B2 | 1/2011 | Winkler et al. |
| 7,872,106 | B2 | 1/2011 | Paszty et al. |
| 8,178,099 | B2 | 5/2012 | Ellies |
| 2003/0165410 | A1 | 9/2003 | Taylor |
| 2003/0166247 | A1 | 9/2003 | Brunkow et al. |
| 2003/0186915 | A1 | 10/2003 | Pan et al. |
| 2003/0229041 | A1 | 12/2003 | Sutherland et al. |
| 2004/0009535 | A1 | 1/2004 | Brunkow et al. |
| 2004/0023356 | A1 | 2/2004 | Krumlauf et al. |
| 2004/0058321 | A1 | 3/2004 | Brunkow et al. |
| 2004/0141875 | A1 | 7/2004 | Doshi |
| 2004/0146888 | A1 | 7/2004 | Paszty et al. |
| 2004/0158045 | A1 | 8/2004 | Brunkow et al. |
| 2004/0192658 | A1* | 9/2004 | Hunter et al. ............ 514/152 |
| 2005/0014650 | A1 | 1/2005 | Seitz et al. |
| 2005/0085418 | A1 | 4/2005 | Winkler et al. |
| 2005/0106683 | A1 | 5/2005 | Winkler et al. |
| 2005/0238646 | A1 | 10/2005 | Ledbetter et al. |
| 2006/0233801 | A1 | 10/2006 | Brunkow et al. |
| 2007/0072797 | A1 | 3/2007 | Robinson et al. |
| 2007/0110747 | A1 | 5/2007 | Paszty et al. |
| 2007/0292444 | A1 | 12/2007 | Krumlauf et al. |
| 2008/0182788 | A1 | 7/2008 | Brunkow et al. |
| 2008/0234219 | A1 | 9/2008 | Brunkow et al. |
| 2009/0074763 | A1 | 3/2009 | Padhi et al. |
| 2009/0117118 | A1 | 5/2009 | Winkler et al. |
| 2009/0304713 | A1 | 12/2009 | Paszty et al. |
| 2010/0015665 | A1 | 1/2010 | Latham et al. |
| 2010/0036091 | A1 | 2/2010 | Robinson et al. |
| 2010/0151524 | A1 | 6/2010 | Winkler et al. |
| 2010/0226928 | A1 | 9/2010 | Dani |
| 2011/0044978 | A1 | 2/2011 | Ke et al. |
| 2011/0097342 | A1 | 4/2011 | Paszty et al. |
| 2011/0150866 | A1 | 6/2011 | Brunkow et al. |

FOREIGN PATENT DOCUMENTS

| | | |
|---|---|---|
| WO | WO-91/13152 | 9/1991 |
| WO | WO-92/01047 | 1/1992 |
| WO | WO-92/02551 | 2/1992 |
| WO | WO-92/06693 | 4/1992 |
| WO | WO-95/30003 | 11/1995 |
| WO | WO-96/04375 | 2/1996 |
| WO | WO-98/21335 | 5/1998 |
| WO | WO-99/03996 | 1/1999 |
| WO | WO-99/06554 | 2/1999 |
| WO | WO-99/15556 | 4/1999 |
| WO | WO-00/32773 | 6/2000 |
| WO | WO-00/44777 | 8/2000 |
| WO | WO-00/75317 | 12/2000 |
| WO | WO-01/64885 | 9/2001 |
| WO | WO-01/92308 | 12/2001 |
| WO | WO-01/98491 | 12/2001 |
| WO | WO-02/24888 | 3/2002 |
| WO | WO-02/30463 | 4/2002 |
| WO | WO-03/050513 | 6/2003 |
| WO | WO-03/087763 | 10/2003 |
| WO | WO-03/106657 | 12/2003 |
| WO | WO-2004/082608 | 9/2004 |
| WO | WO-2004/094477 | 11/2004 |
| WO | WO-2004/098491 | 11/2004 |
| WO | WO-2005/003158 | 1/2005 |
| WO | WO-2005/014650 | 2/2005 |
| WO | WO-2005/115356 | 12/2005 |
| WO | WO-2006/015373 | 2/2006 |
| WO | WO-2006/065746 | 6/2006 |
| WO | WO-2006/102070 | 9/2006 |
| WO | WO-2006/119062 | 11/2006 |
| WO | WO-2006/119107 | 11/2006 |
| WO | WO-2007/080129 | 7/2007 |
| WO | WO-2008/061013 | 5/2008 |
| WO | WO-2008/092894 | 8/2008 |
| WO | WO-2008/115732 | 9/2008 |
| WO | WO-2008/133722 | 11/2008 |
| WO | WO-2009/039175 | 3/2009 |
| WO | WO-2009/047356 | 4/2009 |
| WO | WO-2009/056634 | 5/2009 |
| WO | WO-2009/079471 | 6/2009 |
| WO | WO-2009/131553 | 10/2009 |
| WO | WO-2009/149189 | 12/2009 |
| WO | WO-2010/100179 | 9/2010 |
| WO | WO-2010/100200 | 9/2010 |
| WO | WO-2010/115932 | 10/2010 |
| WO | WO-2010/130830 | 11/2010 |
| WO | WO-2011/128424 | 10/2011 |
| WO | WO-2012/028683 | 3/2012 |
| WO | WO-2012/058393 | 5/2012 |

OTHER PUBLICATIONS

Andersson et. al., Molecular genetics and pathophysiology of 17β-hydroxysteriod dehydrogenase 3 deficiency. *J. Clin. Endrocrinol. Metab.*, 81(1): 130-6 (1996).

Angal et. al., A single amino acid substitution abolishes the heterogeneity of chimeric mouse/human (IgG4) antibody. *Mol. Immunol.*, 30(1):105-8 (1993).

Annex EW6 to Declaration filed in connection with the European Patent EP 1133558 Opposition, Expert opinion of Prof. Dr. Edgar Wingender, dated Sep. 24, 2009.

Annex regarding the purported relevance of gene/peptides mentioned by Professor Arnett, dated Mar. 18, 2011.

Anonymous, Amgen presents denosumab and sclerostin antibody data at American Society for Bone and Mineral Research Annual Meeting. Amgen Media Press Release. <www.amgen.com/media/media_pr_detail.jsp?releaseID=907028> (2006).

Anonymous, UCB on track. UCB News <http://hugin.info/133973/R/1176122/233395.pdf> (2007).

Arnett et. al., Effect of pH on bone resorption by rat osteoclasts in vitro. *Endocrinol.*, 119(1): 119-124 (1986).

Attana Application Example, cited in Opposition against European Patent No. 1721979 by Opponent: Novartis AG, dated Jun. 15, 2011.

Avsian-Kretchmer et. al., Comparative genomic analysis of the eight-membered ring cystine knot-containing bone morphogenetic protein antagonists. *Molec. Endocrinol.*, 18(1):1-12 (2004).

Babcook et. al., A novel strategy for generating monoclonal antibodies from single, isolated lymphocytes producing antibodies of defined specificities. *Proc. Natl. Acad. Sci. USA*, 93:7843-8 (1996).

Baines et. al., Purification of immunoglobulin G (IgG). *Meth. Molec. Biol.*, 10:79-104 (1992).

Balemans et. al., Extracellular regulation of BMP signaling in vertebrates: A cocktail of modulators. *Dev. Biol.*, 250:231-50 (2002).

Balemans et. al., Increased bone density in sclerosteosis is due to the deficiency of a novel secreted protein (SOST). *Hum. Mol. Genet.*, 10:537-43 (2001).

Balemans et. al., Localization of the gene for sclerosteosis to the van Buchem disease-gene region on chromosome 17q12-q21. *Am. J. Hum. Genet.*, 64:1661-9 (1999).

Balint et. al., Antibody engineering by parsimonious mutagenesis. *Gene*, 137(1):109-18 (1993).

Bateman et. al., Granulins: The structure and function of an emerging family of growth factors. *J. Endocrinol.*, 158: 145-51 (1998).

(56) References Cited

OTHER PUBLICATIONS

Baxevanis (Ed.) et. al., Bioinformatics: A practical guide to the analysis of genes and proteins, John Wiley & Sons, Inc. p. 234 (1998).
Beighton et. al., Heterozygous manifestations in the heritable disorders of the skeleton. *Pediatr. Radiol.*, 27: 397-401 (1997).
Beighton et. al., The clinical features of sclerosteosis. *Clin. Genet.*, 25:175-81 (1984).
Beighton et. al., The syndromic status of sclerosteosis and van Buchem disease. *Ann. Intern. Med.*, 84:393-7 (1976).
Bellows et. al., Parathyroid hormone reversibly suppresses the differentiation of osteoprogenitor cells in functional osteoblasts. *Endocrinol.*, 127(6): 3111-6 (1990).
Bendayan, Possibilities of false immunocytochemical results generated by the use of monoclonal antibodies: The example of the anti-proinsulin antibody. *J. Histochem. Cytochem.*, 43(9):881-6 (1995).
Bendig, Humanization of rodent monoclonal antibodies by CDR grafting. *Methods*, 8:83-93 (1995).
Bergfeld et. al., Release of ATP from human erythrocytes in response to a brief period of hypoxia and hypercapnia. *Cardiovascular Res.*, 26: 40-7 (1992).
Berman et. al., The protein data bank. *Acta. Cryst.*, 58(1):899-907 (2002).
Bigger versions of Figures from Declaration of Professor Teresa Attwood, citation in Appeal, European Patent No. 1133558, dated Apr. 13, 2010.
Bird et. al., Single-chain antigen-binding proteins. *Science*, 242:423-6 (1988).
Birren et. al., EMBL sequence database accession No. AC003098.2, Nov. 14, 1997.
Bishop (Ed.), Guide to Human Genome Computing, Second Edition, Academic Press, Chapter 1: Introduction to human genome computer via the world wide web, pp. 1-14 (2003).
Black et. al., A somatic cell hybrid map of the long arm of human chromosome 17, containing the familial breast cancer ILocus (BRCAI). *Am. J. Hum. Genet.*, 52:702-10 (1993).
Blum et. al., Study plan for German students in the summer of 1998, University Bioinformatik lecture announcement (1998).
Boden et. al., Glucocorticoid-induced differentiation of fetal rat calvarial osteoblasts is mediated by bone morphogenetic protein-6. *Endocrinology*, 138(7):2820-8 (1997).
Boerner et. al., Production of antigen-specific human monoclonal antibodies from in vitro-primed human splenocytes. *J. Immunol.*, 147:86-95 (1991).
Bonaldo et. al., EMBL Sequence Database Accession No. AI113131, Sep. 4, 1998.
Bonaldo et. al., Normalization and subtraction: Two approaches to facilitate gene discovery. *Genome Res.*, 6(9):791-806 (1996).
Bondestam, Ligands & Signaling Components of the Transforming Growth Factor, Helsinki University Biomedical Dissertations (2002).
Bork et. al., Go hunting in sequence databases by watch out for the traps. *Trends Genet.*, 12:425-7 (1996).
Bos et. al., Ras ongogenes in human cancer: A review. *Cancer Res.*, 49: 4682-9 (1989).
Bost et. al., Antibodies against a peptide sequence within the HIV envelope protein crossreacts with human interleukin-2. *Immunol. Invest.*, 17(6&7):577-86 (1988).
Bostrom et. al., Ligand and signaling components of the transforming growth factor β family. *J. Orth. Res.*, 13:357-67 (1995).
Bottcher et. al., NCBI Sequence database accession No. NM_004329, Aug. 2, 2009.
Bouffard et. al., A physical map of human chromosome 7: An integrated YAC contig map with average STS spacing of 79 kb. *Genome Res.*, 7: 673-92 (1997).
Bowie et. al., A method to identify protein sequences that fold into a known three-dimensional structure. *Science*, 253:164-70 (1991).
Bowie et. al., Deciphering the message in protein sequences: Tolerance to amino acid substitutions. *Science*, 247(4948):1306-10 (1990).
Bradley et. al., Modifying the mouse: Design and desire. *Bio/Technology*, 10:534-9 (1992).
Brandao-Burch et. al., Acidosis inhibits bone formation by osteoblasts in vitro by preventing mineralization. *Calcif. Tissue Int.*, 77: 167-74 (2005).
Brenner et. al., Population statistics of protein structures: Lessons from structural classifications. *Curr. Op. Struct. Biol.*, 7(3):369-76 (1997).
Brown, Hybridization analysis of DNA blots, *Current Protocols in Protein Science*, 13:A.4H.1-A.4H.9 (1990).
Brown, Hybridization analysis of DNA blots, *Current Protocols in Protein Science*, 2.10.1-2.10.16 (2000).
Bruggemann et. al., Production of human antibody repertoires in transgenic mice. *Curr. Opin. Biotechnol.*, 8:455-8 (1997).
Brunkow et. al., Bone dysplasia sclerosteosis results from loss of the SOST gene product, a novel cysteine knot-containing protein. *Am. J. Hum. Genet.*, 68:577-89 (2001).
Burton et. al., Human antibodies from combinatorial libraries. *Adv. Immunol.*, 57:191-280 (1994).
Butcher et. al., Increased salt concentration reversibly destabilizes p53 quaternary structure and sequence-specific DNA binding. *Biochem. J.*, 298: 513-6 (1994).
Byrne et. al., CD4+CD45RBHi T cell transfer induced colitis in mice is accompanied by osteopenia which is treatable with recombinant human osteoprotegerin. *Gut.*, 54:78-86 (2005).
Campbell et. al., Totipotency or multipotentiality of cultured cells: Applications and progress. *Theriogenology*, 47:63-72 (1997).
Caverzasio et. al., Characteristics and regulation of Pi transport in osteogenic cells for bone metabolism. *Kindey Int.*, 49: 975-80 (1996).
Chan et. al., A new paradigm in the treatment of osteoporosis: Wnt pathway proteins and their antagonists. *Curr. Opin. Invest. Drugs*, 8:293-8 (2007).
Chandran et. al., Recent trends in drug delivery systems: Liposomal drug delivery system—Preparation and characterization. *Indian J. Exp. Biol.*, 35(8):801-9 (1997).
Charlier et. al., A pore mutation in a novel KQT-like potassium channel gene in an idiopathic epilepsy family. *Nat. Genet.*, 18:53-5 (1998).
Chenu et. al., Glutamate receptors are expressed by bone cells and are involved in bone resorption. *Bone*, 22(4): 295-9 (1998).
Chou et. al., Empirical predication of protein conformation. *Ann. Rev. Biochem.*, 47:251-76 (1979).
Chou et. al., Prediction of the secondary structure of proteins from their amino acid sequence. *Adv. Enzymol. Relat. Areas Mol. Biol.*, 47:145-8 (1978).
Clark, Antibody humanization: A case of the 'Emperor's New Clothes'?. *Immunology Today*, 21(8):397-402 (2000).
Cogan et. al., NCBI Sequence Database Accession No. NM_033346, Jul. 19, 2005.
Collins, Identifying human disease genes by positional cloning. The Harvey Lectures, Series 86:149-64 (1992).
Collins, Positional cloning moves from perditional to traditional. *Nat. Genet.*, 9:347-50 (1995).
Colman, Effects of amino acid sequence changes on antibody-antigen interactions. *Biomolec. Res. Inst.*, 55:33-6 (1994).
Communication from the European Patent Office providing an "Observation by a Third Party according to Article 115 EPC" submitted in connection with the Opposition to European Patent No. 1 133 558, dated Dec. 3, 2008.
Cook et. al., Structural basis for a functional antagonist in the transforming growth factor β superfamily. *J. Biol. Chem.*, 280(48):40177-86 (2005).
Cormier, Markers of bone metabolism. *Curr. Opin. in Rheu.*, 7:243-8 (1995).
Couvreur et. al., Polyalkylcyanoacrylates as colloidal drug carriers. *Crit. Rev. Ther. Drug Carrier Syst.*, 5(1):1-20 (1988).
Craig et. al., Sclerostin binds and regulates the activity of cysteine rich protein 61. *Biochem. Biophys. Res. Commun.*, 293(1): 36-40 (2010).

(56) References Cited

OTHER PUBLICATIONS

Craig et. al., Sclerostin-erbB-3 interactions: Modulation of erbB-3 activity by sclerostin. *Biochem. Biophys. Res. Commun.*, 402: 421-4 (2010).
Crameri et. al., DNA shuffling of a family of genes from diverse species accelerates directed evolution. *Nature*, 391:288-91 (1998).
Dall'Acqua et. al., Antibody humanization by framework shuffling. *Methods*, 36(1):43-60 (2005).
Davies, et. al., Affinity improvement of single antibody VH domains: Residues in all three hypervariable regions affect antigen binding. *Immunotechnology*, 2(3): 169-79 (1996).
de Jong et. al., Evolution of the α-crystallin/small heat-shock protein family. *Mol. Biol. Evol.*, 10(1): 103-26 (1993).
Dean et. al., Matrix vesicles produced by osteoblast-like cells in culture become significantly enriched in proteoglycan-degrading metalloproteinases after addition of β-glycerophosphate and ascorbic acid. *Calcif. Tissue*, 54: 399-408 (1994).
Declaration filed in connection with the European Patent EP 1133558 Opposition, Expert opinion of Dr. Auristela Freire de Paes Alves, Ph.D., dated Sep. 9, 2009.
Declaration filed in connection with the European Patent EP 1133558 Opposition, Expert opinion of Dr. Walter Sebald, dated Sep. 24, 2009.
Declaration filed in connection with the European Patent EP 1133558 Opposition, Expert opinion of Prof. Dr. Edgar Wingender, dated Sep. 24, 2009.
Declaration filed in connection with the European Patent EP 1133558 Opposition, Expert opinion of Prof. Dr. Thomas Muller, dated Sep. 23, 2009.
Declaration of Alistair J. Henry, citation in Appeal, European Patent No. 1133558, dated Apr. 2, 2010.
Declaration of Dr. Martyn Robinson, submitted in Opposition to European Patent No. 1133558, dated Jan. 13, 2008.
Declaration of Dr. Mary E. Brunkow, submitted in Opposition to European Patent No. 1133558, dated Jan. 9, 2008.
Declaration of Dr. Raymond Dalgleish dated Dec. 8, 2011, citation in Appeal, European Patent No. 1133558.
Declaration of Prof. Edgar Wingender filed in connection with that Opposition regarding European Patent EP 1133558 B1, dated Mar. 10, 2011.
Declaration of Professor Teresa Attwood, citation in Appeal, European Patent No. 1133558, dated Apr. 13, 2010.
Declaration of Tim Arnett, citation in Appeal, European Patent No. 1133558, dated Apr. 2, 2010.
Delmas et. al., The use of biochemical markers of bone turnover in osteoporosis. *Osteoporosis International*, Suppl. 6:S2-17 (2000).
Diagram of the candidate interval, citation by Propriator in Opposition against European Patent No. 1721979 on Feb. 20, 2012.
Ducy et. al., 5-HT and bone biology. *Curr. Opin. Pharmacol.*, 11: 34-8 (2011).
Ducy et. al., Genetic control of cell differentiation in the skeleton. *Curr. Opin. Cell Biol.*, 10:614-9 (1998).
Durham et. al., Alterations in insulin-like growth factor (IGF)-dependent IGF-binding protein-4 proteolysis in transformed osteoblastic cells. *Endocrinology*, 136(4):1374-80 (1995).
Ebara et. al., Mechanism for the action of bone morphogenetic proteins and regulation of their activity. *Spine*, 27(165):S10-5 (2002).
Eli Lilly Statement of Grounds of Appeal, Opposition to European Patent Application No. 1133558 B1, dated Sep. 28, 2009.
Eli Lilly, Biacore experiment comparison results, Setup assay to measure BMP binding to captured SOST, referenced on p. 41 of reference C193, dated Sep. 28, 2009.
Epstein et. al., Endocrine function in sclerosteosis. *S. Afr. Med. J.*, 55:1105-10 (1979).
European Patent Office Communication, Opposition to European Patent No. 1133558, dated Nov. 4, 2008.

European Patent Office, "Opinion of the Enlarged Board of Appeal dated Dec. 1992 G 1/92", available from [http://documents.epo.org/projects/babylon/eponet.nsf/0/907016FA57B46FD0C12572C8006CD2E2/$File/g920001.pdf], cited Jun. 15, 2011.
Expert Opinion from Dr. Catalina Lopez-Correa, submitted in Opposition to European Patent No. 1133558, dated Mar. 6, 2009.
Expert opinion of Professor Dr.-Ing Ulrich Vollrath, citation in Appeal of European Patent No. 1133558, dated Apr. 12, 2005.
Extract from Sigma Aldrich catalogue, cited in Opposition against European Patent No. 1721979 by Opponent: Laudens, dated Jun. 15, 2011.
Eyre et. al., Characterization of aromatase and 17β-hydroxysteroid dehydrogenase expression in rat osteoblastic cells. *J. Bone Miner. Res.*, 13(6): 996-1004 (1998).
Foster et. al., Establishment of interference in osteoblasts by an osteopetrosis-inducing Avian Leukosis virus. *Virology*, 205: 376-8 (1994).
Fouser et. al., Feedback regulation of collagen gene expression: A Trojan horse approach. *Proc. Natl. Acad. Sci. USA*, 88: 10158-62 (1991).
Frost et. al., On the rat model of human osteopenias and osteoporoses. *Bone and Mineral*, 18:227-36 (1992).
Fujiwara et. al., GenBank Sequence Database Accession No. D79813, Feb. 9, 1996.
Gardner et. al., Bone mineral density in sclerosteosis; Affected individuals and gene carriers. *J. Clin. Endocrinol. Metab.*, 90(12): 6392-5 (2005).
Gavarini et. al., Opposite effects of PSD-95 and MPP3 PDZ proteins on serotonin 5-hydroxytryptamine2C receptor desensitization and membrane stability. *Molec. Biol.*, 17: 4619-31 (2006).
Gazzerro et. al., Bone morphogenetic proteins induce the expression of noggin which limits their activity in cultured rat osteoblasts. *J. Clin. Invest.*, 102(12):2106-14 (1998).
Gazzerro et. al., Potential drug targets within bone morphogenetic protein signaling pathways. *Curr. Opin. Pharmacol.*, 7: 325-3 (2007).
Geissler et la., Male pseudohermaphroditism caused by mutations of testicular 17β-hydroxysteroid hehydrogenase 3. *Nat. Genetics*, 7:34-9 (1994).
Gencic et. al., Conservative amino acid substitution in the myelin proteolipid protein of Jimpymsd mice. *J. Neurosci.*, 10(1):117-24 (1990).
Geysen et. al., Cognitive features of continuous antigenic determinants. *J. Molec. Recog.*, 1(1):32-41 (1988).
Gitelman et. al., Vgr-1/BMP-6 induces osteoblastic differentiation of pluripotential mesenchymal cells. *Cell Growth & Differentiation*, 6:827-36 (1995).
Glasky et. al., Stability of specific immunoglobulin secretion by EBV-transformed lymphoblastoid cells and human-murine heterohybridomas. *Hybridoma*, 8:377-89 (1989).
Gowen et. al., Actions of recombinant human γ-interferon and tumor necrosis factor α on the proliferation and osteoblastic characteristics of human trabecular bone cells in vitro. *Arthritis Rheumatism*, 31(12): 1500-7 (1988).
Graner et. al., Splice variants of the *Drosophila* PS2 integrins differentially interact with RGD-containing fragments of the extracellular proteins tiggrin, Ten-m and D-laminin α2. *J. Biol. Chem.*, 273(29): 18235-41 (1998).
Graves et al., The use of rodent models to investigate host-bacteria interactions related to periodontal diseases, *J. Clin Periodontol.*, 35:89-105 (2008).
Green et al., Cytosolic pH regulation in osteoblasts. *J. Gen. Physiol.*, 95: 121-45 (1990).
Green et. al., Antigen-specific human monoclonal antibodies from mice engineered with human Ig heavy and light chain YACs. *Nat. Genet.*, 7:13 (1994).
Greene et. al., Screening Recombinant DNA Libraries. *Current Protocols in Molecular Biology*, Ch. 6(1) (1990).
Gribskov et. al., Profile analysis. *Meth. Enzym.*, 183:146-59 (1990).
Gribskov et. al., Profile analysis: Detection of distantly related proteins. *Proc. Nat. Acad. Sci. USA*, 84(13):4355-8 (1987).

(56) References Cited

OTHER PUBLICATIONS

Groeneveld et. al., Bone morphogenetic proteins in human bone regeneration. *Eur. J. Endocrinol.*, 142:9-21 (2000).
Gronthos et. al., Integrin expression and function on human osteoblast-like cells. *J. Bone Miner. Res.*, 12(8): 1189-97 (1997).
Groppe et. al., Structural basis of BMP signalling inhibition by the cystine knot protein noggin. *Nature*, 420:636-42 (2002).
Guinness-Hey, Increased trabecular bone mass in rats treated with human synthetic parathyroid hormone. *Metab. Bone Dis. Relat. Res.*, 5:177-81 (1984).
Harlow et. al., Antibodies: A Laboratory Manual, Cold Spring Harbor Laboratory, 141-157 (1988).
Harris, Processing of C-terminal lysine and arginine residues of proteins isolated from mammalian cell culture. *J. Chromatogr.*, 705:129-34 (1995).
Hart et. al., Crystal structure of the human TβR2 ectodomain-TGF-β3 complex. *Nat. Struc. Biol.*, 9(3):203-8 (2002).
Hay et. al., ATCC Cell Line and Hybridomas, American Type Culture Collection, 8th Ed., pp. 149, 258, 428 (1994).
He et. al., High-throughput dynamic light scattering method for measuring viscosity of concentrated protein solutions. *Anal. Biochem.*, 399(1): 141-3 (2010).
Heinecke et. al., Receptor oligomerization and beyond: A case study in bone morphogenetic proteins, *BMC Biol.*, 7: 59 (2009).
Hill et. al., Multiple extracellular signals promote osteoblast survival and apoptosis. *Endocrinology*, 138(9):3849-58 (1997).
Hillier et. al., EMBL Sequence Database Accession No. AA393939, May 19, 1997.
Hillier et. al., GenBank Sequence Database Accession No. AA393768, Apr. 24, 1997.
Hillier et. al., Generation and analysis of 280,000 human expressed sequence tags. *Genome Res.*, 6: 807-28 (1996).
Hilliker et. al., Truncation of the amino terminus of PTH alters its anabolic activity on bone in vivo. *Bone*, 19(5): 469-77 (1996).
Hirschhorn, Letter to the editor: Dominance and homozygosity in man. *Am. J. Med. Genetics*, 18:541 (1984).
Hock et. al., Perspective: Osteoblast apoptosis and bone turnover. *J. Bone Miner. Res.*, 16(6):975-84 (2001).
Hoffman et. al., BMP Signaling Pathways in Cartilage and Bone Formation, *Crit. Rev. Eukaryotic Gene Exp.*, 11(1-3):23-45 (2001).
Hoggard et. al., Localization of leptin receptor mRNA splice variants in murine peripheral tissues by RT-PCR and in situ hybridization. *Biochem. Biophys. Res. Commun.*, 232: 383-7 (1997).
Hollinger et. al., Engineered antibody fragments and the rise of single domains. *Nat. Biotech.*, 23(9):1126-36 (2005).
Holm et. al., Protein folds and families: Sequence and structure alignments. *Nucl. Acid Res.*, 27(1):244-7 (1999).
Holt, et. al., Domain antibodies: Proteins for therapy. *Trends Biotechnol.*, 21(11):484-90 (2003).
Hoogenboom et. al., By-passing immunisation: Human antibodies from synthetic repertoires of germline VH gene segmens rearranged in vitro. *J. Molec. Biol.*, 227:381-8 (1992).
Hoogewerf et. al., Glycosaminoglycans mediate cell surface oligomerization of chemokines. *Biochemistry*, 36: 13570-8 (1997).
Horton et. al., Arg-Gly-Asp (RGD) peptides and the anti-vitronectin receptor antibody 23C6 inhibit dentine resorption and cell spreading by osteoclasts. *Exp. Cell Res.*, 195: 368-75 (1991).
Hsu et. al., The Xenopus dorsalizing factor gremlin indentified a novel family of secreted proteins that antagonize BMP activities. *Molec. Cell*, 1:673-83 (1998).
Hufner et. al., Evidence for an osteoblast-activating factor in a patient with peripheral T-cell lymphoma and osteosclerosis. *Klin. Wochenscher.*, 67: 402-7 (1989).
Hulley et. al., Inhibition of mitogen-activated protein kinase activity and proliferation of an early osteoblast cell line (MBA 15.4) by dexamethasone: Role of protein phosphatases. *Endocrinol.*, 139(5): 2423-31 (1998).
Huse et. al., Generation of a large combinatorial library of the immunoglobulin repertoire in phage lambda. *Science*, 246:1275-81 (1989).

Hwang et. al., Use of human germline genes in a CDR homoloy-based approach to antibody humanization. *Methods*, 36(1):35-42 (2005).
Ide et. al., GenBank Sequence Database Accession No. BAA19765, Feb. 7, 1999.
Ide et. al., GenBank Sequence Datacase Accession No. D89675, Feb. 7, 1999.
Iemura et. al., Direct binding of follistatin to a complex of bone-morphogenetic protein and its receptor inhibits ventral and epidermal cell fates in early Xenopus embryo. *Proc. Natl. Acad. Sci. USA*, 95:9337-42 (1998).
Innis et. al., Evolutionary trace analysis of TGF-B and related growth factors: Implications for stie-directed mutagenesis. *Protein Engineering*, 13(12):839-47 (2000).
Jakobovits et. al., Production of antigen-specific human antibodies from mice engineered with human heavy and light chain YACsa. *Ann. N.Y. Acad. Sci.*, 764:525-35 (1995).
Jee et. al., Overview: Animal models of osteopenia and osteoporosis. *J. Musculoskel. Neuron. Interact.*, 1:193-207 (2001).
Jilka et. al., Increased bone formation by prevention of osteoblast apoptosis with parathyroid hormone. *J. Clin. Invest.*, 104:439-46 (1999).
Jilka et. al., Osteoblast programmed cell death (apoptosis): Modulation by growth factors and cytokines. *J. Bone Miner. Res.*, 13(5): 793-802 (1998).
Jin et al., RANKL inhibition through osteoprotegerin blocks bone loss in experimental periodontitis, *J. Periodontol.*, 78(7):1300-8 (2007).
Jones, Progress in protein structure predication. *Curr. Opin. Struct. Biol.*, 7(3):377-387 (1997).
Kabat et. al., Sequences of proteins of immunological interest, U.S. Department of Health and Human Services, *NIH, USA* (1987) (Table of Contents).
Kalu, The ovariectomized rat model of postmenopausal bone loss. *Bone and Mineral*, 15:175-92 (1991).
Kang et. al., Linkage of recognition and replication functions by assembling combinatorial antibody Fab libraries along phage surfaces. *Proc. Natl. Acad. Sci. USA*, 88:4363-6 (1991).
Katagiri et. al., The non-osteogenic mouse pluripotent cell line, C3H10T1/2, is induced to differentiate into osteoblastic cells by recombinant human bone morphogenetic protein-2. *Biochem. Biophys. Res. Comm.*, 172(1):295-9 (1990).
Kawabata et. al., Signal transduction by bone morphogenetic proteins. *Cytokine and Growth Factor Reviews*, 9(1):49-61 (1998).
Keller et. al., Molecular recognition of BMP-2 and BMP receptor IA. *Nat. Struct. Mol. Biol.*, 11(5):481-488 (2004).
Khalil, TGF-β: From latent to active. *Microbes and Infection*, 1(15):1255-63 (1999).
Khosla et. al., Concise review for primary-care physicians. Treatment pptions for osteoporosis. *Mayo Clin. Proc.*, 70:978-82 (1995).
Kirsch et. al., BMP-2 antagonists emerge from alterations in the low-affinity binding epitope for receptor BMPR-II, *EMBO J.*, 19(13): 3314-24 (2000).
Kohler et. al., Continuous cultures of fused cells secreting antibody of predefined specificity. *Nature*, 256:495 (1975).
Koli et. al., Latency, activation, and binding proteins of TGF-. *Microscopy Res. Tech.*, 52:354-62 (2001).
Koreth et. al., Microsatellites and PCR genomic analysis. *J. Pathology*, 178:239-48 (1996).
Kramer et. al., The gapped duplex DNA approach to oligonucleotide-directed mutation construction. *Nuc. Acids Res.*, 12:9441 (1984).
Krause et. al., Distinct modes of inhibition by sclerostin on bone morphogenetic protein and Wnt signaling pathways. *J. Biol. Chem.*, 285(53): 41614-26 (2010).
Kunkel et. al., Rapid and efficient site-specific mutagenesis without phenoypic selection. *Meth. Enzymol.*, 154:367-82 (1987).
Kunkel, Rapid and efficient site-specific mutagenesis without phenotypic selection. *Proc. Natl. Acad. Sci. USA*, 82:488-92 (1985).
Kurahashi et. al., Regions of genomic instability on 22q11 and 11q23 as the etiology for the recurrent constitutional t (11;22). *Hum. Molec. Genet.*, 9: 1665-70 (2000).

(56) References Cited

OTHER PUBLICATIONS

Kusu et. al., Sclerostin is a novel secreted osteoclast-dervied bone morphogenetic protein antagonist with unique ligand specificity.*J. Biol. Chem.*, 278:24113-7 (2003).

Labat et. al., Retroviral expression in mononuclear blood cells isolated from a patient with osteopetrosis (Albers-Schonberg disease). *J. Bone Miner. Res.*, 5(5): 425-35 (1989).

Labat, A new approach to the study of the origin of genetic disease: Retroviral etiology of osteopetrosis. *Biomed. Pharmacother.*, 45: 23-7 (1991).

Lasic, Novel applications of liposomes. *Trends Biotechnol.*, 16(7):307-21 (1998).

Latham, The biochemical and cellular characterization of sclerostin, The causative gene for sclerostenosis. *Calcified Tissue International*, 70(4):244 (2002).

Leppert et. al., Benign familial neonatal epilepsy with mutations in two potassium channel genes. *Curr. Opin. Neurol.*, 12: 143-7 (1999).

Lewiecki et. al., Sclerostin monoclonal antibody therapy with AMG 785: A potential treatment for osteoporosis. *Exp. Opin. Biol. Ther.*, 11(1): 117-27 (2011).

Li et. al., Sclerostin binds to LRP5/6 and antagonizes canonical Wnt signaling. *J. Biol. Chem.*, 280: 19883-7 (2005).

Li et. al., Treatment with an anti-sclerostin antibody directly stimulates bone formation in a dose-dependent manner in ovariectomized rats with established osteopenia. J. Bone Min. Res., 22(Suppl. S1): S65 (2007).

Lian et. al., Bone Formation: Osteoblast Lineage Cells, Growth Factors, Matrix Proteins, and the Mineralization Process, Primer on the Metabolic Bone Diseases and Disorders of Mineral Metabolism, 4th Edition, 14-29 (1999).

Lierop et. al., Van Buchem disease: Clinical, biochemical and densitometric features of patients and disease carriers. *J. Bone Miner. Res. Accepted Article* (2012).

Liu et. al., GenBank Sequence Database Accession No. U25110, Feb. 2, 1996.

Liu et. al., Human type II receptor for bone morphogenic proteins (BMPs): Extension of the two-kinase receptor model to the BMPs. *Molec. Cell. Biol.*, 15(7):3479-86 (1995).

Lonberg et. al., Antigen-specific human antibodies from mice comprising four distinct genetic modifications. *Nature*, 368:856 (1994).

Loots et. al., Genomic deletion of a long-range bone enhancer misregulates sclerostin in Van Buchem disease. *Genome Res.*, 15: 928-35 (2005).

Low et. al., Mimicking somatic hypermutation: Affinity maturation of antibodies displayed on bacteriophage using a bacterial mutator strain. *J. Mol. Biol.*, 250:350-68 (1996).

Lowik et. al., Wnt signaling is involved in the inhibitory action of sclerostin on BMP-stimulated bone formation. *J. Musculoskeleton Neuronal Interact.* 6: 357 (2006).

Luckman et. al., Heterocycle-containing bisphosphonates cause apoptosis and inhibit bone resorption by preventing protein prenylation: Evidence from structure-activity relationships in J774 macrophages. *J. Bone Miner. Res.*, 13(11): 1668-78 (1998).

Luckman et. al., Nitrogen-containing bisphosphonates inhibit the mevalonate pathway and prevent post-translational prenylation of GTP-binding proteins, including Ras. *J. Bone Miner. Res.*, 13(4): 581-9 (1998).

Malone et. al., Bone anabolism achieved by reducing sclerostin bioavailability with an anti-sclerostin antibody. 37th International Sun Valley Workshop on Skeletal Tissue Biology. Aug. 5-8, 2007.

Mango et. al., Carboxy-terminal truncation activates glp-1 protein to specify vulval fates in Caenorhabditis elegans. *Lett. Nature*, 352: 811-15 (1991).

Margalit et. al., Comparative analysis of structurally defined herparin binding sequences reveals a distinct spatial distribution of basic residues. *J. Biol. Chem.*, 268 (26): 19228-31 (1993).

Margalit, Liposome-mediated drug targeting in topical and regional therapies. *Crit. Rev. Ther. Drug Carrier Syst.*, 12(2-3):233-61 (1995).

Marks et. al., By-passing immunization: Building high affinity human antibodies by chain shuffling. *Bio/Technology*, 10:779-83 (1992).

Matthews et. al., Adenovirus protein-protein interactions: Hexon and protein VI. J. *Gen. Virol.*, 75: 3365-74 (1994).

Mayer et. al., Differentiation of osteogenetic cells: Systems and regulators, Z. Orthop., 130: 276-84 (1992)—Abstract Only.

McClung et. al., Inhibition of sclerostin with AMG 785 in postmenopausal women with low bone mineral density: Phase 2 trial results—Abstract presented at the 2012 meeting of the American Society for Bone and Mineral Reasearch (2012).

Memorandum C, Munich Diplomatic Conference, Sep. 1 to Oct. 6, 1973.

Minabe-Saegusa et. al., Genbank Sequence Database Accession No. AB011030, Jun. 23, 1998.

Minutes of the oral proceedings before the opposition division for Opposition against European Patent No. 1721979, dated May 10, 2013.

Miyazono et. al., Divergence and convergence of TGF-β/BMP signaling. *J. Cell. Physiol.*, 187:265-76 (2001).

Miyazono et. al., TGF-β signaling by Smad proteins.*Adv. Immunology*, 75:115-57 (2000).

Morais et. al., In vitro biomineralization by osteoblast-like cells I. Retardation of tissue mineralization by metal salts. *Biomaterials*, 19: 13-21 (1998).

Mori et. al., A novel amino acid substitution a the receptor-binding site on the hemaglutinin of H3N2 influenza A viruses isolated from 6 cases with acute encephalopathy during 1997-1998 season in Tokyo. *Arch. Virol.*, 144: 147-55 (1999).

Morrison et. al., ATP is a potent stimulator of the activiation and formation of rodent osteoclasts. *J. Physiol.*, 511.2: 495-500 (1998).

Mosekilde et. al., Assessing bone quality—Animcal models in prelinincal osteoporosis research. *Bone*, 17 (4): 343S-52S (1995).

Moult, The current state of the art in protein structure predicion. *Curr. Opin. Biotech.*, 7(4):422-7 (1996).

Mullins et. al., Perspectives series: Molecular medicine in genetically engineered animals; Transgenesis in the rat and larger mammals. *J. Clin. Invest.*, 97(7):1557-60 (1996).

Muntoni et. al., A mutation in the dystrophin gene selectively affecting dystrophin expression in the heart. *J. Clin. Invest.*, 96: 693-9 (1995).

Nagaraja et. al., X chromosome map at 75-kb STS resolution, revealing extremes of recombination and GC content. *Genome Res.*, 7: 210-22 (1997).

Nakase et. al., Transient and localized expression of bone morphogenetic protein 4 messenger RNA during fracture healing. *J. Bone Miner. Res.*, 9(5):651-9 (1994).

Nelson, Positional cloning reaches maturity. *Curr. Opin. Genet. Devel.*, 5:298-303 (1995).

Nickel et. al., The crystal structure of the BMP-2: BMPR-1A complex and the generation of BMP-2 antagonists. *J. Bone Joint Surg.*, 83-A:S1-7-S1-14 (2001).

Nicolas et. al., An age-related decrease in the concentration of insulin-like growth factor binding protein-5 in human cortical bone. *Calcif. Tissue Int.*, 57:206-12 (1995).

Nifuji et. al., Coordinated expression of noggin and bone morphogenetic proteins (BMPs) during early skeletogenesi and induction of noggin expression by BMP-7. *J. Bone Miner. Res.*, 14(12):2057-66 (1999).

Nisonoff et. al., Separation of univalent fragments from the bivalent rabbit antidody molecule by reduction of disulfide bonds. *Arch. Biochem. Biophys.*, 89:230-44 (1960).

Niu et. al., Sclerostin inhibition leads to increased periosteal and endocortical bone formation as well as decreased cortical porosity in aged ovariectomized rats. *J. Bone Min. Res.*, 22(Suppl. S1) S65 (2007).

Nordsletten et. al., The neuronal regulation of fracture healing. *Acta Orthop Scand.*, 65(3): 299-304 (1994).

Notice of Opposition against European Patent No. 1133558, Opponent: Eli Lilly and Company, dated May 31, 2007.

(56) References Cited

OTHER PUBLICATIONS

Notice of Opposition against European Patent No. 1721979, Opponent: Eli Lilly & Company, dated Jun. 15, 2011.
Notice of Opposition against European Patent No. 1721979, Opponent: Laudens, dated Jun. 15, 2011.
Notice of Opposition against European Patent 1721979, Opponent: Novartis AG, dated Jun. 15, 2011.
Notice of Opposition to European Patent No. 1 133 558, dated May 29, 2007.
Nygren et. al., Scaffolds for engineering novel binding sites in proteins. *Curr. Opin. Struct. Biol.*, 7:463-9 (1997).
Observations of Opponent: Laudens in response to summons to oral proceedings in Opposition against European Patent No. 1721979, dated Feb. 25, 2013.
Oelgeschlager et. al., the evolutionarily conserved BMP-binding protein twisted gastrulation promotes BMP signalling. *Nature*, 405:757-63 (2000).
OMIM #607625, Niemann-pick disease, type C2 (2007).
Ominsky, et. al., Sclerostin monoclonal antibody treatment increases bone strength in aged osteopenic ovariectomozed rats. *J. Bone Min. Res.*, 21(1): S44 PRES1161 (2006). Abstract.
Opposition Decision for Opposition against European Patent No. 1721979, dated Aug. 2, 2013.
Opposition Statement of May 20, 2007 filed by Opponent 2 (Eli Lilly) against European Patent No. 1133558.
Oreffo et. al., Human bone marrow osteoprogenitors express estrogen receptor-alpha and bone morphogenetic proteins 2 and 4 mRNA during osteoblastic differentiation. *J. Cell. Biochem.*, 75:382-92 (1999).
Orriss et al., Purinergic signaling and bone remodeling. *Curr. Opin. Pharmacol.*, 10:322-30 (2010).
Oshima et. al., TGF-β receeptor type II deficiency results in defects of yolk Sac hematopoiesis and vasculogenesis. *Dev. Biol.*, 179:297-302 (1996).
Padhi et. al., Anti-sclerostin antibody increases markers of bone formation in healthy postmenopausal women. *J. Bone Min. Res.*, 22: S37 (2007).
Padhi et. al., OC35—Effects of anti-sclerostin monoclonal antibody in healthy postmenopausal women. *Osteoporosis Int.*, 19: Suppl. 1: S19 (2008).
Padlan et. al., Structure of an antibody-antigen complex; Crystal structure of the HyHEL-10 Feb-lysozyme complex. *Proc. Natl. Acad. Sci. USA*, 86:5938-42 (1989).
Palokangas et. al., Endocytic pathway from the basal plasma membrane to the ruffled border membrane in bone-resorbing osteoclasts. *J. Cell Sci.*, 110: 1767-80 (1997).
Pandey et. al., Nucleotide sequence database: A gold mine for biologists. *TIBS.*, 24: 276-80 (1999).
Papapoulos et. al., Targeting sclerostin as potential treatment of osteoporosis. *Ann. Rheum. Dis.*, 70(Suppl. 1): 1119-22 (2011).
Park et al., Three-dimensional micro-computed tomographic imaging of alveolar bone in experimental bone loss or repair, *J. Periodontol.*, 78:273-81 (2007).
Patel et. al., Current and potential future drug treatments for osteoporosis. *Ann. Rheumatic Dis.*, 55: 700-14 (1996).
Patten et. al., Applications of DNA shuffling to pharmaceuticals and vaccines. *Curr. Opin. Biotechnol.*, 8:724-33 (1997).
Pearson et. al., Effective protein sequence comparison. Chapter 15, pp. 227-258 (1996).
Piao et. al., The proximal promotor region of the gene encoding human 17β-hydroxysteroid dehydrogenase type 1 contains GATA, AP-2, and Sp1 response elements: Analysis of promoter function in choriocarcinoma cells. *Endrocrinol.*, 138(8): 3417-25 (1997).
Piccolo et. al., The head inducer Cerberus is a multifunctional antagonist of nodal, BMP and WNT signals. *Nature*, 397: 707-10 (1999).
Piek et. al., Specificity, diversity, and regulation of TGF-β superfamily signaling. *FASEB J.*, 13:2105-24 (1999).
Pietromonaco et. al., Protein kinase C-⊖ phosphorylation of moesin in the actin-binding sequence. *J. Biol. Chem.*, 273:7594-603 (1998).

Pignatti et. al., Tracking disease genes by reverse genetics. *J. Psychiar. Res.*, 26(4):287-98 (1992).
Pittenger et. al., Multilineage potential of adult human mesenchymal stem cells. *Science*, 284:143-7 (1999).
Pluckthun et. al., Expression of functional anitbody Fv and Fab fragments in *Escherichia coli*. *Meth. Enzymol.*, 178:497-515 (1989).
Pockwinse et. al., Expression of cell growth and bone specific genes at single cell resolution during development of bone tissue-like organization in primary osteoblast cultures. *J. Cell. Biol.*, 49:310-23 (1992).
Poole et. al., Sclerostin is a delayed secreted product of osteocytes that inhibit bone formation. *FESEB J.*, 19: 1842-4 (2005).
Porter, The hydrolysis of rabbit γ-globulin and antibodies with crystalline papain. *Biochem. J.*, 73:119-26 (1959).
Proprietor's Response to Opponent's Statement of Grounds of Appeal, European Patent No. 1133558, dated Apr. 15, 2010.
Proprietor's Response to Oppositions against European Patent No. 1721979, UCB Pharma S.A., dated Feb. 20, 2012.
Proprietor's Written submission in preparation for oral proceedings in Opposition against European Patent No. 1721979, Proprietor: UCB Pharma S.A., dated Feb. 25, 2013.
Quintanar-Guerrero et. al., Preparation techniques and mechanisms of formation of biodegradable nanoparticles from preformed polymers. *Drug Dev. Ind. Pharm.*, 24(12):1113-28 (1998).
Rachner et. al., Osteoporosis: Now and the future. *Lancet*, 377(9773): 1276-87 (2011).
Rawadi et. al., BMP-2 controls alkaline phosphatase expression and osteoblast mineralization by a Wnt autocrine loop. *J. Bone Min. Res.*, 18: 1842-53 (2003).
Reb, Antikorpergegen sclerostin, *Medical Tribune*, 39:12 (2007).
Reddi et. al., The *Escherichia coli* chaperonin 60 (groEL) is a potent stimulator of osteoclast formation. *J. Bone Miner. Res.*, 13(8): 1260-6 (1998).
Reddi, Interplay between bone morphogenetic proteins and cognate binding proteins in bone and cartilage development: Noggin, chordin and DAN. *Arthritis Res.*, 3(1):1-5 (2000).
Response to Proprietor's brief of Apr. 15, 2010, European Patent Opposition, EP-1133558 B1, dated Mar. 18, 2011.
Riggs, Overview of osteoporosis. *West J. Med.*, 154:63-77 (1991).
RnD Systems catalogue excerpt, cited in Opposition against European Patent No. 1721979 by Opponent: Novartis AG dated Jun. 15, 2011.
Roberts et. al., Essential functional interactions of SAFA, a *Saccharomyces cerevisiae* complex of Spt, Ada, and Gcn5 proteins, with the Snf/Swi and Srb/Mediator complexes. Genetics, 147: 451-65 (1997).
Robinson et. al., The sclerostin antibody project. *Hum. Antibodies*, 16: 36 (2007).
Roitt et la., Roitt's Essential Immunology, 9th Edition, pp. 90-91 (1997).
Rosenzweig et. al., Cloning and characterization of a human type II receptor for bone morphogenetic proteins. *Proc. Natl. Acad. ScL USA*, 92:7632-7636 (1995).
Rosenzweig et. al., GenBank Sequence Database Accession No. CAA88759, Oct. 7, 2008.
Rosenzweig et. al., GenBank Sequence Database Accession No. Z48923, Oct. 7, 2008.
Rudikoff, et. al., Single amino acid substitution altering antigen-binding specificity. *Proc. Natl. Acad. Sci. USA*, 79:1979-83 (1982).
Ruppert et. al., Human bone morphogenetic protein 2 contains a heparin-binding site which modifies its biological activity. *Eur. J. Biochem.*, 237: 295-302 (1996).
Sada et. al., Adsorption equilibirum in immuno-affinity chromatography with polyclonal and monoclonal antibodies. *Biotechnol. Bioengin.*, 28 (1986). Abstract.
Sali et. al., Comparative protein modeling by satisfaction of spatial restraints. *J. Mol. Biol.*, 234(3):779-815 (1993).
Sambrook et. al., Synthetic oligonucleotide probes, molecular cloning—A Laboratory Manual, Ch.11:11.1-11.19 and 11.58-11.61 (1989).
Sanger et. al., DNA sequencing with chain-terminating inhibitors. *Proc. Natl. Acad. Sci. USA*, 74:5463-7 (1997).

(56) References Cited

OTHER PUBLICATIONS

Sastry et. al., Cloning of the immunological repertoire in *Escherichia coli* for generation of monoclonal catalytic antibodies: Construction of a heavy chain variable region-specific cDNA library. *Proc. Natl. Acad. Sci. USA*, 86:5728-32 (1989).
Scatchard et. al., The attractions of proteins for small molecules and ions. *Ann. N.Y. Acad. Sci.*, 51:660-72 (1949).
Scheufler et. al., Crystal structure of human bone morphogenetic protein-2 at 2.7 A resolution. *J. Mol. Biol.*, 287(1):101-15 (1999).
Schlebusch et. al., Production of a single-chain fragment of the murine anti-idiotypic antibody ACA125 as phage-displayed and soluble antibody by recombinant phage antibody technique. *Hybridoma*, 16:47-52 (1997).
Schlunegger et. al., Refined crystal structure of human transforming growth factor β2 at 1.95 A Resolution. *J. Mol. Biol.*, 231(2):445-458 (1993).
Schmidt et. al., Retrovirus-induced osteopetrosis in mice: Effects of viral infection on osteogenic differentiation in skeletoblast cell cultures. *Am. J. Pathol.*, 129(3): 503-10 (1987).
Schmitt et. al., Bone morphogenetic proteins: An update on basic biology and clinical relevance. *J. Orth. Res.*, 17:269-78 (1999).
Schwappacher et. al., NCBI Sequence Database Accession No. NM_001204, Aug. 16, 2009.
Scully et. al., BRCA1 is a component of the RNA polymerase II holoenzyme. *Proc. Natl. Acad. Sci. USA*, 94: 5605-10 (1997).
Second declaration of Martyn Robinson, citation in Appeal, European Patent No. 1133558, dated Apr. 15, 2010.
Serra et. al., Expression of a truncated, kinase-defective TGF-β type II receptor in mouse skeletal tissue promotes terminal chondrocyte differentiation and osteoarthritis. *J. Cell. Biol.*, 139(2):541-52 (1997).
Sigmund, Viewpoint: Are studies in genetically altered mice out of control? *Arterioscler. Thromb. Vasc. Biol.*, 20:1425-9 (2000).
Silverman et. al., Sclerostin, *J. Osteoporosis*, 2010: 1-3 (2010).
Sippl et. al., Threading thrills and threats. *Structure*, 4(1):15-19 (1996).
Siris, Clinical Review: Paget's disease of bone. *J. Bone Miner. Res.*, 13(7): 1061-5 (1998).
Sivakumar et. al., New insights into extracellular matrix assembly and reorganization from dynamic imaging of extracellular matrix proteins in living osteoblasts. *J. Cell. Sci.*, 119(7):1350-60 (2006).
Skiple Skjerpen et. al., Binding of FGF-1 variants to protein kinase CK2 correlates with mitogenicity. *Embo J.*, 21(15): 4058-69 (2002).
Slater et. al., Involvement of platelets in stimulating osteogenic activity. *J. Orthopaedic Res.*, 13: 655-63 (1995).
Smith et. al., Glucocorticoids inhibit development stage-specific osteoblast cell cycle. *J. Biol. Chem.*, 275:19992-20001 (2000).
Smith, TGF β inhibitors, new and unexpected requirements in vertebrate development. *TIG*, 15(1):3-5 (1999).
Sohocki et. al., A range of clinical phenotypes associated with mutations in CRX, a photoreceptor transcription-factor gene. *Am. J. Hum. Genet.*, 63: 1307-15 (1998).
Spranger, International classification of osteochondrodysplasias, *Eur. J. Pediatr.*, 151: 407-15 (1992).
Staehling-Hampton et. al., a 52-kb delection in the SOST-MEOX1 intergenic region on 17g12-q21 is associated with van Buchem disease in the Dutch population. *Am. J. Med. Gen.*, 110: 144-52 (2002).
Stanley et. al., DAN is a secreted glycopeotein related to Xenopus cerberus. *Mech. Dev.*, 77: 173-84 (1998).
Statement of Grounds of Appeal to Decision of Opposition against European Patent No. 1133558, dated Sep. 28, 2009.
Stenmark et. al., Distinct structural elements of rab5 define its functional specificity. *EMBO J.*, 13(3): 575-83 (1994).
Strachan et. al. (Eds.), Diagram from text book entitled Human Molecular Genetics, 2nd Edition (1999).
Strachan et. al. (Eds.), Human Molecular Genetics, 1st Edition, p. 420 (1996).
Strachan et. al., (Eds.), Human Molecular Genetics, 2nd Edition, Figure 15.4 (1999).

Submission in response to oral proceedings in Opposition against European Patent No. 1721979, Opponent: Eli Lilly, dated Apr. 24, 2013.
Sudo et. al., In vitro differentiation and calcification in a new clonal osteogenic cell line derived from newborn mouse calvaria. *J. Cell Biol.*, 96:191-8 (1983).
Summons to attend oral proceedings for Opposition against European Patent No. 1133558, dated Nov. 4, 2008.
Summons to attend oral proceedings in Opposition against European Patent No. 1721979, dated Nov. 12, 2012.
Sutherland et. al., Sclerostin romotes the apoptosis of human osteoblastic cells: A novel regulation of bone formation. *Bone*, 35:828-35 (2004).
Suzawa et. al., Extracellular matrix-associated bone morphogenetic proteins are essential for differentiation of murine osteoblastic cells in vitro. *Endocrinology*, 140:2125-33 (1999).
Sverdlov et. al., Perpetually mobile footprints of ancient infections in human genome. *FEBS Lett.*, 428: 1-6 (1998).
Sylatron label, cited in Opposition against European Patent No. 1721979 by Opponent: Novartis AG, dated Jun. 15, 2011.
Takakura, Drug delivery systems in gene therapy. *Nippon Rinsho*, 56(3):691-5 (1998) (Abstract Only).
Takeda et. al., GenBank Sequence Database Accession No. AAB33865, May 27, 1995.
Takeda et. al., GenBank Sequence Database Accession No. D38082, dated Dec. 27, 2006.
Takeda et. al., GenBank Sequence Database Accession No. S75359, May 27, 1995.
Takeda et. al., NCBI Sequence Database Accession No. NM_030849, Feb. 11, 2009.
Takeda, Expression of serine/threonine kinase receptors during ectopic bone formation induced by bone morphogenetic protein (BMP). *Kokubyo Gakkai Zasshi*, 61(4):512-26 (1994).
Tam et. al., TGF-β receptor expression on human keratinocytes: A 150 kDa GPI-anchored TGF-β1 binding protein forms a heteromeric complex with type I and type II receptors. *J. Cellular Biochem.*, 70:573-56 (1998).
Taylor et. al., Human immunoglobulin transgenes undergo rearrangement, somatic mutation and class switching in mice that lack endogenous IgM. *Int. Immun.*, 6:579 (1994).
The Merck Manual-Second Home Edition, Ch. 61:1-3 (2005).
Thompson et. al., Affinity maturation of a high-affinity human monoclonal antibody against the third hypervariable loop of human immunodeficiency virus: Use of phage display to improve affinity and broaden strain reactivity. *J. Mol. Biol.*, 256:7-88 (1996).
Thornton et. al., Prediction of progress at last. *Nature*, 354:105-6 (1991).
Tjaderhane et. al., A high sucrose diet decreases the mechanical strength of bones in growing rats. *J. Nutr.*, 128: 1807-10 (1998).
Tuncay et. al., Oxygen tension regulates osteoblast function. *Am. J. Orthod. Dentofac. Orthop.*, 105: 457-63 (1994).
UCB and Amgen announce positive phase 2 results of CDP7851/AMG785 in patients with post menopausal osteoporosis (PMO), dated Apr. 21, 2011—Citation in Opposition against European Patent No. 1721979.
Uitterlinden et. al., Relation of alleles of the collagen type Iα1 gene to bone density and the risk of osteoporotic fractures in postmenopausal women. *New Engl. J. Med.*, 338: 1016-21 (1998).
Utting et al., Hypoxia stimulates osteoclast formation from human peripheral blood. *Cell Biochem. Funct.*, 28:374-80 (2010).
Valero et. al., Quaternary structure of casein kinase 2. *J. Biol. Chem.*, 27(14): 8345-52 (1995).
van Bezooijen et. al., Sclerostin is an osteocyte-expressed negative regulator of bone formation, but not a classical BMP antagonist. *J. Exp. Med.*, 199: 805-14 (2004).
van Bezooijen et. al., SOST/sclerostin, an osteocyte-derived negative regulator of bone formation, *Cytokine Growth Factor Rev.*, 16: 319-27 (2005).
van Bezooijen et. al., Wnt but not BMP signaling is involved in the inhibitory action of sclerostin on BMP-stimulated bone formation. *J. Bone. Miner. Res.*, 22:19-28 (2007).

(56) References Cited

OTHER PUBLICATIONS

Van Hul et. al., Van Buchem Disease (hyperostosis corticalis generalisata) maps to chromosome 17q12-a21. *Am. J. Hum. Genet.*, 2:391-9 (1998).
Vanier et. al., Recent advances in elucidating Niemann-Pick C disease. *Brain Pathol.*, 8: 163-74 (1998).
Veverka et. al., Characterization of the structural features and interactions of sclerostin. *J. Biol. Chem.*, 284(16): 10890-900 (2009).
Viter et. al., Analysis of antigenic structure of potato virus M Ukrainian strains. *Biopolimery I Kletka, Naukova Dumka, Kiev K, UK*, 16: 312-9 (2000).
Von Bubnoff et. al., Intracellular BMP signaling regulation in vertebrates: Pathway or network? *Dev. Biol.*, 239:1-14 (2001).
Wall, Transgenic livestock: Progress and prospects for the future. *Theriogenology*, 45:57-68 (1996).
Wang et. al., IFP 35 forms complexes with B-ATF, a member of the AP1 family of transcription factors. Biochem. Biophys. *Res. Commun.*, 229: 316-22 (1996).
Wang, Bone morphogenetic proteins (BMP5): Therapeutic potential in healing bony defects. *TIBTECH*, 11:379-83 (1993).
Warmington et. al., Sclerostin antagonism in adult rodents, via monoclonal antibody mediated blockade, increases bone mineral density and implicates sclerostia as a key regulator of bone mass during adulthood. *J. Bone Min. Res.*, 19:S56-7 (2004).
Warmington et. al., Sclerostin monoclonal antibody treatment of osteoporotic rats completely reverses one year of overiectomy-induced systemic bone loss, *J. Bone Min. Res.*, 20:S22 (2005).
Winkler et. al., Noggin and sclerostin bone morphogenetic protein antagonists form a mutually inhibitory complex. *J. Biol. Chem.*, 279(35): 36296-8 (2004).
Winkler et. al., Osteocyte control of bone formation via sclerostin, a novel BMP antagonist. *EMBO J.* 22: 6267-76 (2003).
Winkler et. al., Sclerostin inhibition of Wnt-3a-induced C3H10T1/2 cell differentiation is indirect and mediated by bone morphogenetic proteins. *J. Biol. Chem.* 280: 2498-502 (2005).
Winter et. al., Making antibodies by phase display technology. *Annu. Rev. Immunol.*, 12:433-55 (1994).
Wolff et. al., Monoclonal antibody homodimers: Enhanced antitumor activity in nude mice. Cancer Res., 53:2560-5 (1993).
Wollenberger et. al. (Eds.), Analytische Biochemie, Chapter 3, pp. 47-49 (2003).
Written submission—Observation by a Third Party According to Art.115 EPC, Opposition to European Patent No. 1133558, dated Nov. 25, 2008.
Written submission in response to summons to oral proceedings in Opposition against European Patent No. 1721979, Opponent: Norvartis AG, dated Feb. 25, 2013.
Written submission in response to summons to oral proceedings in Opposition against European Patent No. 1721979, Opponent: Eli Lilly Company, dated Feb. 25, 2013.
Written submission of Eli Lilly & Company to European Patent Office, Opposition to European Patent No. 1133558, dated May 29, 2007.
Written Submission of Eli Lilly & Company, Opposition to European Patent No. 1133558, dated Mar. 9, 2009.
Written submission of UCB S.A., Proprietor's Preliminary Response to the Opponent's submission of Mar. 9, 2009, Opposition to European Patent No. 1133558, dated Mar. 20, 2009.
Written submission of UCB S.A., Proprietor's Response to Opposition against European Patent No. 1133558, dated Mar. 14, 2008.
Yanagita et. al., USAG-1: A bone morphogenetic protein antagonist abundantly expressed in the kidney. *Biochem. Biophys. Res. Comm.* ,316: 490-550 (2004).
Yang et. al., CDR walking mutagenesis for the affinity maturation of a potent human Anti-HIV-1 antibody into the picomolar range. *J. Mol. Biol.*, 254:392-403 (1995).
Yates et. al., Inhibition of bone resorption by inorganic phosphate in mediated by both reduced osteoclast formation and decreased activity of mature osteoclasts. *J. Bone Miner. Res.*, 6(5):476-8 (1990).
Yerges et. al., NCBI Sequence Database Accession No. NM_001203, Jul. 12, 2009.
Yerges et. al., NCBI Sequence Database Accession No. NP_001194, Jul. 12, 2009.
Yoshida et. al., Osteoinduction capability of recombinant human bone morphogenetic protein-2 in intramuscular and subcutaneous sites: An experimental study. *J. Cranio-Maxillofac. Surg.*, 26: 112-5 (1998).
Zambaux et. al., Influence of experimental parameters on the characteristics of poly(lactic acid) nanoparticles prepared by a double emulsion method. *J. Controlled Rel.*, 50(1-3):31-40 (1998).
Zhang et. al., Humanization of an anti-human TNF-β antibody by variable region resurfacing with the aid of molecular modeling. *Molec. Immunol.*, 42(12):1445-51 (2005).
Zimmerman et. al., The spemann organizer signal noggin binds and inactives bone morphogenetic protein 4. *Cell*, 86(4):599-606 (1996).
Zlotogora et. al., Dominance and homozygosity, *Am. J. Med. Genet.*, 68: 412-6 (1997).
zur Muhlen et. al., Solid lipid nanoparticles (SLN) for controlled drug delivery—Drug release and release mechanism. *Eur. J. Pharm. Biopharm.*, 45(2):149-55 (1998).
International Searching Authority, International Search Report and Written Opion issued in connection with PCT/US2012/068975, Mar. 1, 2013.

\* cited by examiner

Figure 1A

| Sequence Description | Sequence |
|---|---|
| Ab-A and Ab-1 CDR-L1 | QSSQSVYDNNWLA (SEQ ID NO: 54) |
| Ab-A and Ab-1 CDR-L2 | DASDLAS (SEQ ID NO: 55) |
| Ab-A and Ab-1 CDR-L3 | QGAYNDVIYA (SEQ ID NO: 56) |
| Ab-A and Ab-1 CDR-H1 | SYWMN (SEQ ID NO: 51) |
| Ab-A and Ab-1 CDR-H2 | TIDSGGRTDYASWAKG (SEQ ID NO: 52) |
| Ab-A and Ab-1 CDR-H3 | NWNL (SEQ ID NO: 53) |
| Ab-A light chain | SEQ ID NO: 23 |
| Ab-A heavy chain | SEQ ID NO: 27 |
| Ab-1 light variable region (with signal sequence) | SEQ ID NO: 75 |
| Ab-1 heavy variable region (with signal sequence) | SEQ ID NO: 77 |
| Ab-B CDR-L1 | SASSSVSFVD (SEQ ID NO: 60) |
| Ab-B CDR-L2 | RTSNLGF (SEQ ID NO: 61) |
| Ab-B CDR-L3 | QQRSTYPPT (SEQ ID NO: 62) |
| Ab-B CDR-H1 | TSGMGVG (SEQ ID NO: 57) |
| Ab-B CDR-H2 | HIWWDDVKRYNPVLKS (SEQ ID NO: 58) |
| Ab-B CDR-H3 | EDFDYDEEYYAMDY (SEQ ID NO: 59) |
| Ab-B light chain | SEQ ID NO: 31 |
| Ab-B heavy chain | SEQ ID NO: 35 |
| Ab-C CDR-L1 | KASQSVDYDGDSYMN (SEQ ID NO: 48) |
| Ab-C CDR-L2 | AASNLES (SEQ ID NO: 49) |
| Ab-C CDR-L3 | QQSNEDPWT (SEQ ID NO: 50) |
| Ab-C CDR-H1 | DCYMN (SEQ ID NO: 45) |

Figure 1B

| Sequence Description | Sequence |
|---|---|
| Ab-C CDR-H2 | DINPFNGGTTYNQKFKG (SEQ ID NO: 46) |
| Ab-C CDR-H3 | SHYYFDGRVPWDAMDY (SEQ ID NO: 47) |
| Ab-C light chain | SEQ ID NO: 15 |
| Ab-C heavy chain | SEQ ID NO: 19 |
| Ab-D CDR-L1 | QASQGTSINLN (SEQ ID NO: 42) |
| Ab-D CDR-L2 | GSSNLED (SEQ ID NO: 43) |
| Ab-D CDR-L3 | LQHSYLPYT (SEQ ID NO: 44) |
| Ab-D CDR-H1 | DHYMS (SEQ ID NO: 39) |
| Ab-D CDR-H2 | DINPYSGETTYNQKFKG (SEQ ID NO: 40) |
| Ab-D CDR-H3 | DDYDASPFAY (SEQ ID NO: 41) |
| Ab-D light chain | SEQ ID NO: 7 |
| Ab-D heavy chain | SEQ ID NO: 11 |
| Ab-2 CDR-L1 | RASSSVYYYMH (SEQ ID NO: 275) |
| Ab-2 CDR-L2 | ATSNLAS (SEQ ID NO: 276) |
| Ab-2 CDR-L3 | QQWSSDPLT (SEQ ID NO: 277) |
| Ab-2 CDR-H1 | DYFIH (SEQ ID NO: 287) |
| Ab-2 CDR-H2 | RLDPEDGESDYAPKFQD (SEQ ID NO: 288) |
| Ab-2 CDR-H3 | EDYDGTYTFFPY (SEQ ID NO: 289) |
| Ab-2 light chain | SEQ ID NO: 117 |
| Ab-2 heavy chain | SEQ ID NO: 121 |
| Ab-3 and Ab-15 CDR-L1 | SVSSTISSNHLH (SEQ ID NO: 278) |
| Ab-3 and Ab-15 CDR-L2 | GTSNLAS (SEQ ID NO: 279) |
| Ab-3 and Ab-15 CDR-L3 | QQWSSYPLT (SEQ ID NO: 280) |
| Ab-3 and Ab-15 CDR-H1 | DFYLH (SEQ ID NO: 290) |

Figure 1C

| Sequence Description | Sequence |
|---|---|
| Ab-3 and Ab-15 CDR-H2 | RIDPENGDTLYDPKFQD (SEQ ID NO: 291) |
| Ab-3 and Ab-15 CDR-H3 | EADYFHDGTSYWYFDV (SEQ ID NO: 292) |
| Ab-3 light chain | SEQ ID NO: 125 |
| Ab-3 heavy chain | SEQ ID NO: 129 |
| Ab-15 light variable region | SEQ ID NO: 384 |
| Ab-15 heavy variable region | SEQ ID NO: 386 |
| Ab-15 light chain | SEQ ID NO: 221 |
| AB-15 heavy chain | SEQ ID NO: 225 |
| Ab-4 and Ab-5 CDR-L1 | RASQDISNYLN (SEQ ID NO: 78) |
| Ab-4 and Ab-5 CDR-L2 | YTSRLLS (SEQ ID NO: 79) |
| Ab-4 and Ab-5 CDR-L3 | QQGDTLPYT (SEQ ID NO: 80) |
| Ab-4 and Ab-5 CDR-H1 | DYNMH (SEQ ID NO: 245) |
| Ab-4 and Ab-5 CDR-H2 | EINPNSGGAGYNQKFKG (SEQ ID NO: 246) |
| Ab-4 and Ab-5 CDR-H3 | LGYDDIYDDWYFDV (SEQ ID NO: 247) |
| Ab-4 light chain | SEQ ID NO: 133 |
| Ab-4 heavy chain | SEQ ID NO: 137 |
| Ab-5 light variable region | SEQ ID NO: 376 |
| Ab-5 heavy variable region | SEQ ID NO: 378 |
| Ab-5 light chain | SEQ ID NO: 141 |
| Ab-5 heavy chain | SEQ ID NO: 145 |
| Ab-6 CDR-L1 | RASQDISNYLN (SEQ ID NO: 81) |
| Ab-6 CDR-L2 | YTSRLHS (SEQ ID NO: 99) |
| Ab-6 CDR-L3 | QQGDTLPYT (SEQ ID NO: 100) |
| Ab-6 CDR-H1 | DYNMH (SEQ ID NO: 248) |

Figure 1D

| Sequence Description | Sequence |
|---|---|
| Ab-6 CDR-H2 | EINPNSGGSGYNQKFKG (SEQ ID NO: 249) |
| Ab-6 CDR-H3 | LVYDGSYEDWYFDV (SEQ ID NO: 250) |
| Ab-6 light chain | SEQ ID NO: 149 |
| Ab-6 heavy chain | SEQ ID NO: 153 |
| Ab-7 CDR-L1 | RASQVITNYLY (SEQ ID NO: 101) |
| Ab-7 CDR-L2 | YTSRLHS (SEQ ID NO: 102) |
| Ab-7 CDR-L3 | QQGDTLPYT (SEQ ID NO: 103) |
| Ab-7 CDR-H1 | DYNMH (SEQ ID NO: 251) |
| Ab-7 CDR-H2 | EINPNSGGAGYNQQFKG (SEQ ID NO: 252) |
| Ab-7 CDR-H3 | LGYVGNYEDWYFDV (SEQ ID NO: 253) |
| Ab-7 light chain | SEQ ID NO: 157 |
| Ab-7 heavy chain | SEQ ID NO: 161 |
| Ab-8 CDR-L1 | RASQDISNYLN (SEQ ID NO: 104) |
| Ab-8 CDR-L2 | YTSRLLS (SEQ ID NO: 105) |
| Ab-8 CDR-L3 | QQGDTLPYT (SEQ ID NO: 106) |
| Ab-8 CDR-H1 | DYNMH (SEQ ID NO: 254) |
| Ab-8 CDR-H2 | EINPNSGGAGYNQKFKG (SEQ ID NO: 255) |
| Ab-8 CDR-H3 | LGYDDIYDDWYFDV (SEQ ID NO: 256) |
| Ab-8 light chain | SEQ ID NO: 165 |
| Ab-8 heavy chain | SEQ ID NO: 169 |
| Ab-9 CDR-L1 | RASQDISNYLN (SEQ ID NO: 107) |
| Ab-9 CDR-L2 | YTSRLFS (SEQ ID NO: 108) |
| Ab-9 CDR-L3 | QQGDTLPYT (SEQ ID NO: 109) |
| Ab-9 CDR-H1 | DYNMH (SEQ ID NO: 257) |

Figure 1E

| Sequence Description | Sequence |
|---|---|
| Ab-9 CDR-H2 | EINPNSGGAGYNQKFKG (SEQ ID NO: 258) |
| Ab-9 CDR-H3 | LGYDDIYDDWYFDV (SEQ ID NO: 259) |
| Ab-9 light chain | SEQ ID NO: 173 |
| Ab-9 heavy chain | SEQ ID NO: 177 |
| Ab-10 CDR-L1 | RASQDISNYLN (SEQ ID NO: 110) |
| Ab-10 CDR-L2 | YTSRLLS (SEQ ID NO: 111) |
| Ab-10 CDR-L3 | QQGDTLPYT (SEQ ID NO: 112) |
| Ab-10 CDR-H1 | DYNMH (SEQ ID NO: 260) |
| Ab-10 CDR-H2 | EINPNSGGAGYNQKFKG (SEQ ID NO: 261) |
| Ab-10 CDR-H3 | LGYDDIYDDWYFDV (SEQ ID NO: 262) |
| Ab-10 light chain | SEQ ID NO: 181 |
| Ab-10 heavy chain | SEQ ID NO: 185 |
| Ab-11 and Ab-16 CDR-L1 | RASSSISYIH (SEQ ID NO: 281) |
| Ab-11 and Ab-16 CDR-L2 | ATSNLAS (SEQ ID NO: 282) |
| Ab-11 and Ab-16 CDR-L3 | QQWSSDPLT (SEQ ID NO: 283) |
| Ab-11 and Ab-16 CDR-H1 | DYYIH (SEQ ID NO: 293) |
| Ab-11 and Ab-16 CDR-H2 | RVDPDNGETEFAPKFPG (SEQ ID NO: 294) |
| Ab-11 and Ab-16 CDR-H3 | EDYDGTYTWFPY (SEQ ID NO: 295) |
| Ab-11 light chain | SEQ ID NO: 189 |
| Ab-11 heavy chain | SEQ ID NO: 193 |
| Ab-16 light variable region | SEQ ID NO: 388 |
| Ab-16 heavy variable region | SEQ ID NO: 390 |
| Ab-16 light chain | SEQ ID NO: 229 |
| Ab-16 heavy chain | SEQ ID NO: 233 |

Figure 1F

| Sequence Description | Sequence |
|---|---|
| Ab-12 CDR-L1 | RASQDISNYLN (SEQ ID NO: 113) |
| Ab-12 CDR-L2 | YTSTLQS (SEQ ID NO: 114) |
| Ab-12 CDR-L3 | QQGDTLPYT (SEQ ID NO: 115) |
| Ab-12 CDR-H1 | DYNMH (SEQ ID NO: 263) |
| Ab-12 CDR-H2 | EINPNSGGSGYNQKFKG (SEQ ID NO: 264) |
| Ab-12 CDR-H3 | LGYYGNYEDWYFDV (SEQ ID NO: 265) |
| Ab-12 light chain | SEQ ID NO: 197 |
| Ab-12 heavy chain | SEQ ID NO: 201 |
| Ab-13 and Ab-14 CDR-L1 | RASSSVTSSYLN (SEQ ID NO: 284) |
| Ab-13 and Ab-14 CDR-L2 | STSNLAS (SEQ ID NO: 285) |
| Ab-13 and Ab-14 CDR-L3 | QQYDFFPST (SEQ ID NO: 286) |
| Ab-13 and Ab-14 CDR-H1 | DYYMN (SEQ ID NO: 296) |
| Ab-13 and Ab-14 CDR-H2 | DINPYNDDTTYNHKFKG (SEQ ID NO: 297) |
| Ab-13 and Ab-14 CDR-H3 | ETAVITTNAMD (SEQ ID NO: 298) |
| Ab-13 light chain | SEQ ID NO: 205 |
| Ab-13 heavy chain | SEQ ID NO: 209 |
| Ab-14 light variable region | SEQ ID NO: 380 |
| Ab-14 heavy variable region | SEQ ID NO: 382 |
| Ab-14 light chain | SEQ ID NO: 213 |
| Ab-14 heavy chain | SEQ ID NO: 217 |
| Ab-17 and Ab-18 CDR-L1 | SVSSSISSSNLH (SEQ ID NO: 116) |
| Ab-17 and Ab-18 CDR-L2 | GTSNLAS (SEQ ID NO: 237) |
| Ab-17 and Ab-18 CDR-L3 | QQWTTTYT (SEQ ID NO: 238) |
| Ab-17 and Ab-18 CDR-H1 | DYYIH (SEQ ID NO: 266) |

Figure 1G

| Sequence Description | Sequence |
|---|---|
| Ab-17 and Ab-18 CDR-H2 | RIDPDNGESTYVPKFQG (SEQ ID NO: 267) |
| Ab-17 and Ab-18 CDR-H3 | EGLDYGDYYAVDY (SEQ ID NO: 268) |
| Ab-17 light variable region (with signal sequence) | SEQ ID NO: 299 |
| Ab-17 heavy variable region (with signal sequence) | SEQ ID NO: 301 |
| Ab-18 light variable region (with signal sequence) | SEQ ID NO: 303 |
| Ab-18 heavy variable region (with signal sequence) | SEQ ID NO: 305 |
| Ab-19, Ab-20 and Ab-23 CDR-L1 | RASQDISSYLN (SEQ ID NO: 239) |
| Ab-19, Ab-20 and Ab-23 CDR-L2 | STSRLNS (SEQ ID NO: 240) |
| Ab-19, Ab-20 and Ab-23 CDR-L3 | QQDIKHPT (SEQ ID NO: 241) |
| Ab-19, Ab-20 and Ab-23 CDR-H1 | DYIMH (SEQ ID NO: 269) |
| Ab-19, Ab-20 and Ab-23 CDR-H2 | YINPYNDDTEYNEKFKG (SEQ ID NO: 270) |
| Ab-19, Ab-20 and Ab-23 CDR-H3 | SIYYYDAPFAY (SEQ ID NO: 271) |
| Ab-19 light variable region | SEQ ID NO: 314 |
| Ab-19 heavy variable region | SEQ ID NO: 327 |
| Ab-19 light chain (with signal sequence) | SEQ ID NO: 307 |
| Ab-19 heavy chain (with signal sequence) | SEQ ID NO: 309 |
| Ab-20 light variable region (with signal sequence) | SEQ ID NO: 311 |
| Ab-20 heavy variable region (with signal sequence) | SEQ ID NO: 313 |
| Ab-23 light variable region | SEQ ID NO: 364 |
| Ab-23 heavy variable region | SEQ ID NO: 366 |
| Ab-23 light chain | SEQ ID NO: 341 |

Figure 1H

| Sequence Description | Sequence |
|---|---|
| Ab-23 heavy chain | SEQ ID NO: 345 |
| Ab-21 and Ab-22 CDR-L1 | KASQDVFTAVA (SEQ ID NO: 242) |
| Ab-21 and Ab-22 CDR-L2 | WASTRHT (SEQ ID NO: 243) |
| Ab-21 and Ab-22 CDR-L3 | QQYSSYPLT (SEQ ID NO: 244) |
| Ab-21 and Ab-22 CDR-H1 | DYYMH (SEQ ID NO: 272) |
| Ab-21 and Ab-22 CDR-H2 | RIDPENGDHYDPKFQG (SEQ ID NO: 273) |
| Ab-21 and Ab-22 CDR-H3 | DAGDPAWFTY (SEQ ID NO: 274) |
| Ab-21 light variable region (with signal sequence) | SEQ ID NO: 315 |
| Ab-21 heavy variable region (with signal sequence) | SEQ ID NO: 317 |
| Ab-22 light variable region | SEQ ID NO: 368 |
| Ab-22 heavy variable region | SEQ ID NO: 370 |
| Ab-24 CDR-L1 | KASQSVDYDGTSYMN (SEQ ID NO: 351) |
| Ab-24 CDR-L2 | AASNLES (SEQ ID NO: 352) |
| Ab-24 CDR-L3 | QQSNEDPFT (SEQ ID NO: 353) |
| Ab-24 CDR-H1 | TYWMN (SEQ ID NO: 358) |
| Ab-24 CDR-H2 | MIHPSASEIRLDQKFKD (SEQ ID NO: 359) |
| Ab-24 CDR-H3 | SGEWGSMDY (SEQ ID NO: 360) |
| Ab-24 light chain | SEQ ID NO: 350 |
| Ab-24 heavy chain | SEQ ID NO: 357 |
| CDR SEQ ID NO: 20 of WO 2008/115732 | GYTFTDYFLN (SEQ ID NO: 416) |
| CDR SEQ ID NO: 21 of WO 2008/115732 | TIYPYHDGTTYSQKFKG (SEQ ID NO: 417) |
| CDR SEQ ID NO: 22 of WO 2008/115732 | EEEDGQFDY (SEQ ID NO: 418) |
| CDR SEQ ID NO: 23 of WO 2008/115732 | SASQGIQWYLN (SEQ ID NO: 419) |

Figure 1I

| Sequence Description | Sequence |
|---|---|
| CDR SEQ ID NO: 24 of WO 2008/115732 | YTSSLHS (SEQ ID NO: 420) |
| CDR SEQ ID NO: 25 of WO 2008/115732 | QQHSKLPRT (SEQ ID NO: 421) |
| CDR SEQ ID NO: 26 of WO 2008/115732 | GFPIKDTFQH (SEQ ID NO: 422) |
| CDR SEQ ID NO: 27 of WO 2008/115732 | WSDPEIGDTEYASKFQG (SEQ ID NO: 423) |
| CDR SEQ ID NO: 28 of WO 2008/115732 | GDTTYKFDF (SEQ ID NO: 424) |
| CDR SEQ ID NO: 29 of WO 2008/115732 | KASQDVHTAVA (SEQ ID NO: 425) |
| CDR SEQ ID NO: 30 of WO 2008/115732 | WASTRWT (SEQ ID NO: 426) |
| CDR SEQ ID NO: 31 of WO 2008/115732 | QQYSDYPWT (SEQ ID NO: 427) |
| CDR SEQ ID NO: 32 of WO 2008/115732 | DFEIKDYYIH (SEQ ID NO: 428) |
| CDR SEQ ID NO: 33 of WO 2008/115732 | QIDAEDGETEYAPRFQG (SEQ ID NO: 429) |
| CDR SEQ ID NO: 34 of WO 2008/115732 | QIDAEDGETEYAPRFQG (SEQ ID NO: 430) |
| CDR SEQ ID NO: 35 of WO 2008/115732 | QIDAEDGETEYAPRFQG (SEQ ID NO: 431) |
| CDR SEQ ID NO: 36 of WO 2008/115732 | STSELAS (SEQ ID NO: 432) |
| CDR SEQ ID NO: 37 of WO 2008/115732 | QQLSHLPLT (SEQ ID NO: 433) |
| CDR SEQ ID NO: 4 of WO 2009/047356 | GFTFRSHWLS (SEQ ID NO: 443) |
| CDR SEQ ID NO: 15 of WO 2009/047356 | WVSNINYDGSSTYYADSVKG (SEQ ID NO: 454) |
| CDR SEQ ID NO: 26 of WO 2009/047356 | DTYLHFDY (SEQ ID NO: 465) |
| CDR SEQ ID NO: 37 of WO 2009/047356 | SGDNIGSFYVH (SEQ ID NO: 476) |
| CDR SEQ ID NO: 48 of WO 2009/047356 | LMIYDVNNRPS (SEQ ID NO: 487) |
| CDR SEQ ID NO: 59 of WO 2009/047356 | QSYAGSYLSE (SEQ ID NO: 498) |
| CDR SEQ ID NO: 135 of WO 2010/130830 | DNVMG (SEQ ID NO: 745) |
| CDR SEQ ID NO: 136 of WO 2010/130830 | IYNMD (SEQ ID NO: 746) |
| CDR SEQ ID NO: 137 of WO 2010/130830 | RFDMS (SEQ ID NO: 747) |
| CDR SEQ ID NO: 138 of WO 2010/130830 | SYFMG (SEQ ID NO: 748) |

Figure 1J

| Sequence Description | Sequence |
|---|---|
| CDR SEQ ID NO: 139 of WO 2010/130830 | IYNMD (SEQ ID NO: 749) |
| CDR SEQ ID NO: 140 of WO 2010/130830 | RYVTG (SEQ ID NO: 750) |
| CDR SEQ ID NO: 141 of WO 2010/130830 | SFVIG (SEQ ID NO: 751) |
| CDR SEQ ID NO: 142 of WO 2010/130830 | QYTIT (SEQ ID NO: 752) |
| CDR SEQ ID NO: 143 of WO 2010/130830 | IYNMD (SEQ ID NO: 753) |
| CDR SEQ ID NO: 153 of WO 2010/130830 | WYRQAPGKQRELVA (SEQ ID NO: 763) |
| CDR SEQ ID NO: 154 of WO 2010/130830 | WFRQTPGKERELIA (SEQ ID NO: 764) |
| CDR SEQ ID NO: 155 of WO 2010/130830 | WFRQAPGKQREFIA (SEQ ID NO: 765) |
| CDR SEQ ID NO: 156 of WO 2010/130830 | WFRQAPGKEREVVA (SEQ ID NO: 766) |
| CDR SEQ ID NO: 157 of WO 2010/130830 | WFLQAPGKERELIA (SEQ ID NO: 767) |
| CDR SEQ ID NO: 158 of WO 2010/130830 | WFRQAPGKEREVVA (SEQ ID NO: 768) |
| CDR SEQ ID NO: 159 of WO 2010/130830 | WFRQAPGKQREVVA (SEQ ID NO: 769) |
| CDR SEQ ID NO: 160 of WO 2010/130830 | WFRQAPGKEREFVA (SEQ ID NO: 770) |
| CDR SEQ ID NO: 161 of WO 2010/130830 | WFRQGSGKGRELIA (SEQ ID NO: 771) |
| CDR SEQ ID NO: 171 of WO 2010/130830 | GTIVTGTWRSDY (SEQ ID NO: 781) |
| CDR SEQ ID NO: 172 of WO 2010/130830 | GDTGGAAYGY (SEQ ID NO: 782) |
| CDR SEQ ID NO: 173 of WO 2010/130830 | LGIEYA (SEQ ID NO: 783) |
| CDR SEQ ID NO: 174 of WO 2010/130830 | AKGIGVYGY (SEQ ID NO: 784) |
| CDR SEQ ID NO: 175 of WO 2010/130830 | GVTGGAAYGY (SEQ ID NO: 785) |
| CDR SEQ ID NO: 176 of WO 2010/130830 | AELPGTYDY (SEQ ID NO: 786) |
| CDR SEQ ID NO: 177 of WO 2010/130830 | AEPAGVYDV (SEQ ID NO: 787) |
| CDR SEQ ID NO: 178 of WO 2010/130830 | DRRGLASTRAADYDY (SEQ ID NO: 788) |
| CDR SEQ ID NO: 179 of WO 2010/130830 | GDTGGASYGY (SEQ ID NO: 789) |

METHOD OF TREATING ALVEOLAR BONE LOSS THROUGH THE USE OF ANTI-SCLEROSTIN ANTIBODIES

CROSS-REFERENCE TO RELATED APPLICATIONS

The present application is a National Stage Application based on International Patent Application No. PCT/US2012/068975, filed Dec. 11, 2012, which claims the benefit of priority to U.S. Provisional Application No. 61/580,964, filed Dec. 28, 2011. This disclosure of the priority applications being incorporated herein by reference in its entirety.

TECHNICAL FIELD OF THE INVENTION

The invention generally relates to methods of using sclerostin inhibitors to treat alveolar bone loss.

INCORPORATION BY REFERENCE OF MATERIAL SUBMITTED ELECTRONICALLY

Incorporated by reference in its entirety is a computer-readable nucleotide/amino acid sequence listing submitted concurrently herewith and identified as follows: ASCII (text) file named "46570_SeqListing.txt," 805,989 bytes, created on Dec. 7, 2012.

INCORPORATION BY REFERENCE

The following applications are hereby incorporated by reference in their entirety: U.S. patent application Ser. No. 11/410,540 (issued as U.S. Pat. No. 8,003,108), filed Apr. 25, 2006, which claims priority to U.S. Provisional Patent Application No. 60/792,645, filed Apr. 17, 2006, U.S. Provisional Patent Application No. 60/782,244, filed Mar. 13, 2006, U.S. Provisional Patent Application No. 60/776,847, filed Feb. 24, 2006, and U.S. Provisional Patent Application No. 60/677,583, filed May 3, 2005; and U.S. patent application Ser. No. 11/411,003 (issued as U.S. Pat. No. 7,592,429), filed Apr. 25, 2006, which claims priority to U.S. Provisional Patent Application No. 60/792,645, filed Apr. 17, 2006, U.S. Provisional Patent Application No. 60/782,244, filed Mar. 13, 2006, U.S. Provisional Patent Application No. 60/776,847, filed Feb. 24, 2006, and U.S. Provisional Patent Application No. 60/677,583, filed May 3, 2005. The following applications also are hereby incorporated by reference: U.S. patent application Ser. No. 12/212,327 issued as U.S. Pat. No. 8,017,120), filed Sep. 17, 2008, which claims priority to U.S. Provisional Patent Application No. 60/973,024, filed Sep. 17, 2007; and U.S. patent application Ser. No. 12/811,171, filed Jun. 29, 2010, which is a U.S. National Phase Application pursuant to 35 U.S.C. §371 of International Patent Application No. PCT/US08/86864, filed on Dec. 15, 2008, which claims priority to U.S. Provisional Patent Application No. 61/013,917, filed Dec. 14, 2007.

BACKGROUND OF THE INVENTION

Periodontal infections and gingival inflammations are known to be major causes of periodontal diseases. Both are chronic inflammatory diseases, and as they progress, the periodontal tissue is destroyed and the alveolar bone is reduced due to bone resorption causing loss of tooth support in some cases. In addition, the alveolar bone may become defective due to perforations caused by surgical treatments or apical lesions from progressed dental caries.

SUMMARY OF THE INVENTION

The invention is directed to methods of using a sclerostin inhibitor to enhance alveolar bone. In one aspect, described herein is a method of treating alveolar bone loss in a subject comprising administering a sclerostin inhibitor (e.g., an anti-sclerostin antibody or antibody fragment) in an amount effective to decrease the distance between the cement-enamel junction and the alveolar bone crest, optionally at a dose from about 5 mg to about 1,000 mg per week. In one embodiment, the sclerostin inhibitor is administered twice a week for the duration of the treatment period. In another embodiment, the sclerostin inhibitor is administered once a week for the duration of the treatment period.

The treatment period can be at least about 1 week, 2 weeks, 3 weeks, 4 weeks, 5 weeks, 6 weeks, 7 weeks, 8 weeks, 9 weeks, 10 weeks, 11 weeks, 12 weeks, 3 months, 13 weeks, 14 weeks, 15 weeks, 16 weeks, 4 months, 17 weeks, 18 weeks, 19 weeks, 20 weeks, 5 months, 21 weeks, 22 weeks, 23 weeks, 24 weeks, 6 months, 25 weeks, 26 weeks, 27 weeks 28 weeks, 7 months, 29 weeks, 30 weeks, 31 weeks or longer (e.g., 8 months, 9 months, 10 months, 11 months, 1 year, 15 months, 18 months or longer). In some embodiments, the treatment period is about 6-12 weeks. In some embodiments, the treatment period is 4-12 weeks, or about 1-3 months. In some embodiments, the treatment period is about 12-20 weeks, or about 3-5 months. In some embodiments, the treatment period is about 20-32 weeks, or about 5-8 months. In some embodiments, the treatment period is about 24-36 weeks, or about 6-9 months. In some embodiments, the treatment period is no more than about 28 weeks. In some embodiments, the treatment period is about 1 year. In some or any embodiments, the treatment period is no more than about 18 months.

In some or any embodiments, the distance between the cement-enamel junction and the alveolar bone crest is decreased by at least 10% (e.g., at least 10%, at least 20%, at least 30%, at least 40%, at least 50%, at least 60%, at least 70%, at least 80%, at least 90% or more) compared to the pre-treatment distance by six weeks after initiation of treatment. In some or any embodiments, the distance between the cement-enamel junction and the alveolar bone crest is decreased by at least 10% (e.g., at least 10%, at least 20%, at least 30%, at least 40%, at least 50%, at least 60%, at least 70%, at least 80%, at least 90% or more) compared to a control subject (i.e., a subject with advanced periodontal disease that did not receive treatment with the sclerostin inhibitor) by six weeks after initiation of treatment. In some embodiments, the distance between the cement-enamel junction and the alveolar bone crest is restored to the pre-disease state by six weeks after initiation of treatment. In some embodiments, the distance between the cement-enamel junction and the alveolar bone crest is less than or equal to about 2 mm (e.g., about 2 mm, about 1.9 mm, about 1.8 mm, about 1.7 mm, about 1.6 mm, about 1.5 mm, about 1.4 mm, about 1.3 mm, about 1.2 mm, about 1.1 mm or about 1 mm) by six weeks after initiation of treatment.

In some or any embodiments, the alveolar bone height is increased by at least 10% (e.g., at least 10%, at least 20%, at least 30%, at least 40%, at least 50%, at least 60%, at least 70%, at least 80%, at least 90% or more) compared to the pre-treatment alveolar bone height by six weeks after initiation of treatment. In some or any embodiments, the alveolar bone height is increased by at least 10% (e.g., at least 10%, at least 20%, at least 30%, at least 40%, at least 50%, at least 60%, at least 70%, at least 80%, at least 90% or more) compared to a control subject (i.e., a subject with advanced periodontal disease that did not receive treatment with the sclerostin inhibitor) by six weeks after initiation of treatment. In some embodiments, the alveolar bone height is restored to pre-disease state alveolar bone height by six weeks after initiation of treatment.

In some or any embodiments, the alveolar bone height is increased by at least 0.1 mm (e.g., at least about 0.1 mm, about 0.2 mm, about 0.3 mm, about 0.4 mm, about 0.5 mm, about 0.6 mm, about 0.7 mm, about 0.8 mm, about 0.9 mm, about 1 mm, about 1.5 mm, about 2 mm, about 2.5 mm, about 3 mm, about 3.5 mm, about 4 mm, about 4.5 mm, about 5 mm, about 5.5 mm, about 6 mm, about 6.5 mm, about 7 mm, about 7.5 mm, about 8 mm, about 8.5 mm, about 9 mm, about 9.5, or about 10 mm) or more compared to pre-treatment alveolar bone height or compared to a control subject (i.e., a subject with advanced periodontal disease that did not receive treatment with the sclerostin inhibitor) by six weeks after initiation of treatment.

In some or any embodiments, the alveolar bone density is increased by at least 10% (e.g., at least 10%, at least 20%, at least 30%, at least 40%, at least 50%, at least 60%, at least 70%, at least 80%, at least 90% or more) compared to the pre-treatment alveolar bone density or compared to a control subject (i.e., a subject with advanced periodontal disease that did not receive treatment with the sclerostin inhibitor) by six weeks after initiation of treatment. In some embodiments, the alveolar bone density is restored to pre-disease state by six weeks after initiation of treatment.

In some or any embodiments, the alveolar bone volume fraction (BVF) is increased by at least 10% (e.g., at least 10%, at least 20%, at least 30%, at least 40%, at least 50%, at least 60%, at least 70%, at least 80%, at least 90% or more) compared to the pre-treatment alveolar BVF or compared to a control subject (i.e., a subject with advanced periodontal disease that did not receive treatment with the sclerostin inhibitor) by six weeks after initiation of treatment.

In some or any embodiments, the methods described herein may further comprise measuring the bone mineral density of the alveolar bone prior to the administration of the sclerostin inhibitor (e.g., anti-sclerostin antibody or antibody fragment) to identify subjects in need of treatment with the sclerostin inhibitor. Subjects presenting with alveolar bone density measurements of less than about 750 Hounsfield Units (e.g., about 750 HU, about 700 HU, about 650 HU, about 600 HU, about 550 HU, about 500 HU, about 450 HU, about 400 HU or less) are identified as subjects in need of treatment with the anti-sclerostin antibody or antibody fragment.

The alveolar bone loss for treatment by the methods described herein includes, but is not limited to, alveolar bone loss associated with periodontitis (e.g., advanced periodontal disease), tooth loss, tooth extraction, denture wearing, oral surgery, osteolmyelitis, osteoradionecrosis, developmental deformities (e.g., defects at birth such as missing portions of the teeth, facial bones or jaw), sinus deficiencies, misalignment, or trauma (e.g., avulsed tooth or jaw fracture). In some embodiments, the subject to be treated is suffering from advanced periodontitis.

In some embodiments, the alveolar bone loss is produced by removal of sections of bone containing a tumor (e.g. benign tumor). Exemplary benign bone tumors include, but are not limited to, osteoma, osteoid osteoma, osteoblastoma, osteochondroma, enchondroma, chonrdomyxoid fibroma, aneurysmal bone cyst, unicameral bone cyst, fibrous dysplasia of bone, and giant cell tumor of the bone.

In some or any embodiments, the sclerostin inhibitor (e.g. anti-sclerostin antibody or antibody fragment) is administered in combination with the use of materials that support the regrowth of bone such as bone graft, bone dust, bone chips, demineralized bone matrix, bone scaffolds, prosthesis, metal stabilizers, or bone scaffold substances comprising one or more of polymers, ceramics, cement and calcium phosphates-based bone-graft substitutes. Many variations of such materials are known in the art.

In some or any embodiments, the method comprises administering a standard of care therapy for the treatment of the periodontal disease to the subject prior to administering the sclerostin inhibitor (e.g., anti-sclerostin antibody or antibody fragment). For example, in some embodiments, the standard of care therapy for the treatment of periodontal disease is a therapeutic, including but not limited to, Periostat® and/or chemically modified tetracycline-3 (CMT-3). In some embodiments, the standard of care therapy comprises oral irrigation and/or scaling and supra- and/or sub-gingival debridement (e.g., removal of microbial plaque and calculus) of the affected area of the subject. In some embodiments, the standard of care comprises performing oral irrigation and/or scaling and debridement of the affected area in combination with Periostat and/or CMT-3 prior to administration of the sclerostin inhibitor. In some embodiments, the method comprises administering the standard of care therapy concurrently with the administration of the sclerostin inhibitor. In other embodiments, the standard of care therapy is administered sequentially. For example, the standard of care therapy can be administered 1 day, 2 days, 3 days, 4 days, 5 days, 6 days, 1 week, 2 weeks, 3 weeks, 4 weeks, 6 weeks, 8 weeks, 10 weeks, 12 weeks or more prior to administering the sclerostin inhibitor to the subject. In preferred embodiments, the periodontal disease progression in the subject is slowed, halted or reversed prior to administration of the sclerostin inhibitor.

In some or any embodiments, the method further comprises administering an antibiotic, such as an antibiotic selected from the group consisting of amoxicillin, tetracycline hydrochloride, doxycycline, minocycline, azithromycin, roxithromycin, moxifloxacin, ciprofloxacin and metronidazole. In some embodiments, the method comprises administering the antibiotic to the subject prior to administering or after administering the sclerostin inhibitor to the subject. In other embodiments, the method comprises administering the antibiotic to the subject concurrently with the administration of the sclerostin inhibitor.

In some or any embodiments, the method further comprises administering a second bone-enhancing therapeutic for the treatment of decreased bone mineral density or bone fracture. Many therapeutics of this type are known in the art. In some embodiments, the bone-enhancing therapeutic is selected from the group consisting of an anti-resorptive drug, a bone-forming agent, an estrogen receptor modulator (including, but not limited to, raloxifene, bazedoxifene and lasofoxifene) and a drug that has an inhibitory effect on osteoclasts. In some embodiments, the second bone-enhancing agent is selected from the group consisting of, a bisphosphonate (including, but not limited to, alendronate sodium (FOSAMAX®), risedronate, ibandronate sodium (BONIVA®) and zoledronic acid (RECLAST®)), an estrogen or estrogen analogue, a calcium source, Tibolone, calcitonin, a calcitriol and hormone replacement therapy. In some embodiments, the second bone-enhancing agent includes, but is not limited to parathyroid hormone (PTH) or a peptide fragment thereof, PTH-related protein (PTHrp), bone morphogenetic protein, osteogenin, NaF, a $PGE_2$ agonist, a statin, an anti-DKK1 antibody or inhibitor, an anti-RANK ligand (RANKL) antibody (e.g., PROLIA®) or RANKL inhibitor, strontium ranelate, vitamin D, or a vitamin D derivative or mimic thereof. In some embodiments, the second bone-enhancing agent is Forteo® (Teriparatide, or recombinant human parathyroid hormone analog (1-34)) or Preotact® (parathyroid hormone). In some or any embodiments, the bone-enhancing agent is Protelos®.

In some embodiments, the second bone-enhancing agent is administered concurrently with the sclerostin inhibitor (e.g., for a length of time within the treatment period). In other embodiments, the second bone-enhancing agent is administered for a length of time once the treatment period with the sclerostin inhibitor has ended (i.e., for a maintenance period). In such embodiments, the second bone-enhancing agent is administered for a maintenance period of about 1 week to about 5 years.

The method may further comprise subsequently administering one or more amounts of a sclerostin inhibitor effective to maintain bone mineral density, optionally for a maintenance period of at least about 12 weeks, 6 months, 1 year, 2 years, 3 years, 4 years, 5 years or longer (e.g., over the lifetime of the subject) after the treatment period has ended.

Periodontal disease treatment plans may also include supportive follow-up therapy after active treatment is completed. Supportive follow-up therapies include, but are not limited to mechanical debridement, reinforcement of oral hygiene (e.g., regular professional cleanings, daily brushing and flossing) and administration of antibiotics.

In any of the embodiments disclosed herein, the sclerostin inhibitor is optionally a sclerostin binding agent (e.g., an anti-sclerostin antibody or antibody fragment). The use of a sclerostin binding agent disclosed in U.S. Patent Publication No. 2007/0110747 in any of the methods disclosed herein or for preparation of medicaments for administration according to any of the methods disclosed herein is specifically contemplated. One or more doses of the sclerostin inhibitor are administered in an amount and for a time effective to treat alveolar bone loss. In various embodiments, one or more doses comprising from about 50 milligrams to about 1,000 milligrams of sclerostin inhibitor are administered per week to a subject (e.g., a human subject). For example, a dose of sclerostin inhibitor (e.g., anti-sclerostin antibody or antibody fragment) can comprise at least about 5 mg, 15 mg, 25 mg, 50 mg, about 60 mg, about 70 mg, about 80 mg, about 90 mg, about 100 mg, about 120 mg, about 150 mg, about 200 mg, about 240 mg, about 250 mg, about 280 mg, about 300 mg, about 350 mg, about 400 mg, about 420 mg, about 450 mg, about 500 mg, about 550 mg, about 600 mg, about 650 mg, about 700 mg, about 750 mg, about 800 mg, about 850 mg, about 900 mg, about 950 mg or up to about 1,000 mg of sclerostin inhibitor. Ranges between any and all of these endpoints are also contemplated, e.g. about 50 mg to about 80 mg, about 70 mg to about 140 mg, about 75 mg to about 100 mg, about 100 mg to about 150 mg, about 140 mg to about 210 mg, or about 150 mg to about 200 mg, or about 280 to about 410 mg. The dose is administered at any interval, such as multiple times a week (e.g., twice or three times per week), once a week, once every two weeks, once every three weeks, or once every four weeks. In some or any embodiments, a dose of sclerostin inhibitor (e.g., anti-sclerostin antibody or antibody fragment) ranging from about 120 mg to about 210 mg is administered twice a week. In some or any embodiments, a dose of about 140 mg of the sclerostin inhibitor (e.g., anti-sclerostin antibody or antibody fragment) is administered twice a week.

In some embodiments, the one or more doses of sclerostin inhibitor can comprise between about 0.1 to about 50 milligrams (e.g., between about 5 and about 50 milligrams), or about 1 to about 100 milligrams, of sclerostin inhibitor per kilogram of body weight (mg/kg). For example, the dose of sclerostin inhibitor (e.g., anti-sclerostin antibody or antibody fragment) may comprise at least about 0.1 mg/kg, 0.5 mg/kg, 1 mg/kg, about 2 mg/kg, about 3 mg/kg, about 4 mg/kg, about 5 mg/kg, about 6 mg/kg, about 7 mg/kg, about 8 mg/kg, about 9 mg/kg, about 10 mg/kg, about 20 mg/kg, about 25 mg/kg, about 26 mg/kg, about 27 mg/kg, about 28 mg/kg, about 29 mg/kg, about 30 mg/kg, about 31 mg/kg, about 32 mg/kg, about 33 mg/kg, about 34 mg/kg, about 35 mg/kg, about 36 mg/kg, about 37 mg/kg, about 38 mg/kg, about 39 mg/kg, about 40 mg/kg, about 41 mg/kg, about 42 mg/kg, about 43 mg/kg, about 44 mg/kg, about 45 mg/kg, about 46 mg/kg, about 47 mg/kg, about 48 mg/kg, or about 49 mg/kg, or about 50 mg/kg, about 55 mg/kg, about 60 mg/kg, about 65 mg/kg, about 70 mg/kg, about 75 mg/kg, about 80 mg/kg, about 85 mg/kg, about 90 mg/kg, about 95 mg/kg, or up to about 100 mg/kg. Ranges between any and all of these endpoints are also contemplated, e.g., about 1 mg/kg to about 3 mg/kg, about 1 mg/kg to about 5 mg/kg, about 1 mg/kg to about 10 mg/kg, about 1 mg/kg to about 20 mg/kg, about 1 mg/kg to about 40 mg/kg, about 5 mg/kg to about 30 mg/kg, or about 5 mg/kg to about 20 mg/kg.

Also described herein is the use of an effective amount of an anti-sclerostin inhibitor for treating alveolar bone loss in a subject, for example, in any of the amounts described above, such as from about 50 mg to about 1,000 mg per week, wherein one or more administrations of the sclerostin binding agent is carried out over a treatment period lasting at least 1 week, 2 weeks, 3 weeks, 4 weeks, 5 weeks, 6 weeks, 7 weeks, 8 weeks, 9 weeks, 10 weeks, 11 weeks, 12 weeks, 3 months, 13 weeks, 14 weeks, 15 weeks, 16 weeks, 4 months, 17 weeks, 18 weeks 19 weeks, 20 weeks, 5 months, 21 weeks, 22 weeks, 23 weeks, 24 weeks, 6 months, 25 weeks, 26 weeks, 27 weeks, 28 weeks, 7 months, 29 weeks, 30 weeks, 31 weeks or longer (e.g., 8 months, 9 months, 10 months, 11 months, 1 year, 15 months, 18 months or longer).

In some or any embodiments, the sclerostin inhibitor is administered subcutaneously. In other embodiments, the sclerostin inhibitor is administered locally to the jaw of the subject. In some or any embodiments, the sclerostin inhibitor is administered locally to the diseased gingival area of the subject. In some or any embodiments, the sclerostin inhibitor is administered to the periodontal pocket of the subject.

The sclerostin inhibitor (e.g., anti-sclerostin antibody or antibody fragment) may be also used in the preparation of a medicament for administration to a subject with alveolar bone loss using any of the dosing and/or timing regimens described herein. Thus, the invention also contemplates sclerostin inhibitor for use according to any of the dosing and/or timing regimens described herein. Optionally, the sclerostin inhibitor is presented in a container, such as a single dose or multidose vial or syringe. The invention includes a container comprising anti-sclerostin antibody or fragment thereof and instructions for administering the antibody or fragment thereof for treating alveolar bone loss according to any of the dosing and/or timing regimens described herein.

In various embodiments, the sclerostin inhibitor is a sclerostin binding agent, e.g., an anti-sclerostin antibody or antibody fragment. Optionally, the anti-sclerostin antibody or antibody fragment cross-blocks the binding of at least one of antibodies Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, and Ab-24 to sclerostin and/or is cross-blocked from binding to sclerostin by at least one of antibodies Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, and Ab-24.

In some embodiments, the anti-sclerostin antibody comprises a CDR-H1 of SEQ ID NO:245, a CDR-H2 of SEQ ID NO:246, a CDR-H3 of SEQ ID NO:247, a CDR-L1 of SEQ ID NO:78, a CDR-L2 of SEQ ID NO:79 and a CDR-L3 of SEQ ID NO:80.

In one embodiment, the anti-sclerostin antibody comprises heavy chains comprising SEQ ID NO: 378 and light chains comprising SEQ ID NO: 376. In another embodiment, anti-sclerostin antibody has heavy chains of SEQ ID NO: 145 or SEQ ID NO: 392 and light chains of SEQ ID NO: 141.

In another embodiment, the anti-sclerostin antibody comprises CDRs of SEQ ID NOs: 20-25 of International Patent Publication No. WO 2008/115732 (SEQ ID NOs: 416-421), CDRs of SEQ ID NOs: 26-31 of International Patent Publication No. WO 2008/115732 (SEQ ID NOs: 422-427), CDRs of SEQ ID NOs: 32-37 of International Patent Publication No. WO 2008/115732 (SEQ ID NOs: 428-433), or CDRs of SEQ ID NOs: 4, 15, 26, 37, 48, and 59 of International Patent Publication No. WO 2009/047356 (SEQ ID NOs: 443, 454, 465, 476, 487, and 498, respectively). In yet another embodiment, the anti-sclerostin antibody comprises an amino acid sequence of at least one of SEQ ID NOs: 135-143, 153-161, or 171-179 of International Patent Publication No. WO 2010/130830 (SEQ ID NOs: 745-753, 763-771, 781-789, respectively).

Also contemplated are dental implants, matrices, gels and wound dressings comprising an anti-sclerostin antibody (or antibody fragment) described herein. In some embodiments, the dental implants, matrices, gels and wound dressings are coated with an anti-sclerostin antibody (or antibody fragment). In other embodiments, the anti-sclerostin antibody (or antibody fragment) is formulated with a carrier described herein and applied to a target area (i.e., diseased gingival area or diseased periodontal pocket of the subject), optionally prior to (or after) application of a dental implant, matrices or wound dressing. The anti-sclerostin antibody (or antibody fragment) can be applied by any means known in the art. In some embodiments, the sclerostin antibody (or antibody fragment) is administered to a target area by subcutaneous injection prior to the application of the dental implant, matrix or wound dressing. In other embodiments, the sclerostin antibody (or antibody fragment) is administered to the affected area by brushing or otherwise coating the affected area prior to the application of the dental implant, matrix or wound dressing.

In addition, the use of an anti-sclerostin antibody (or antibody fragment) in any of the methods disclosed herein or for preparation of medicaments for administration according to any of the methods disclosed herein is specifically contemplated. In this regard, the invention includes an anti-sclerostin antibody for use in a method of treating alveolar bone loss in a subject, the method comprising administering an anti-sclerostin antibody (or antibody fragment) in an amount effective to decrease the distance between the cement-enamel junction and the alveolar bone crest, optionally at a dose from about 5 mg to about 1,000 mg per week.

The invention also includes the use of an anti-sclerostin antibody (or antibody fragment) in preparation of a medicament for treating alveolar bone loss in a subject in an amount effective to decrease the distance between the cement-enamel junction and the alveolar bone crest, wherein the anti-sclerostin antibody (or antibody fragment) is optionally at a dose from about 5 mg to about 1,000 mg per week.

The foregoing summary is not intended to define every aspect of the invention, and additional aspects are described in other sections, such as the Detailed Description. The entire document is intended to be related as a unified disclosure, and it should be understood that all combinations of features described herein are contemplated, even if the combination of features are not found together in the same sentence, or paragraph, or section of this document. With respect to aspects of the invention described or claimed with "a" or "an," it should be understood that these terms mean "one or more" unless context unambiguously requires a more restricted meaning. The term "or" should be understood to encompass items in the alternative or together, unless context unambiguously requires otherwise. If aspects of the invention are described as "comprising" a feature, embodiments also are contemplated "consisting of" or "consisting essentially of" the feature.

BRIEF DESCRIPTION OF THE FIGURES

FIGS. 1A through FIG. 1J is a chart listing amino acid sequences and sequence identifiers for amino acid sequences of various anti-sclerostin antibodies described herein. The sequence identifiers refer to amino acid sequences provided in the Sequence Listing submitted herewith. The amino acid sequences also are set forth in U.S. Patent Publication No. 2007/0110747 or International Patent Publication Nos. WO 2008/115732, WO 2009/047356, or WO 2010/130830, hereby incorporated by reference.

DETAILED DESCRIPTION OF THE INVENTION

Figure 2A:
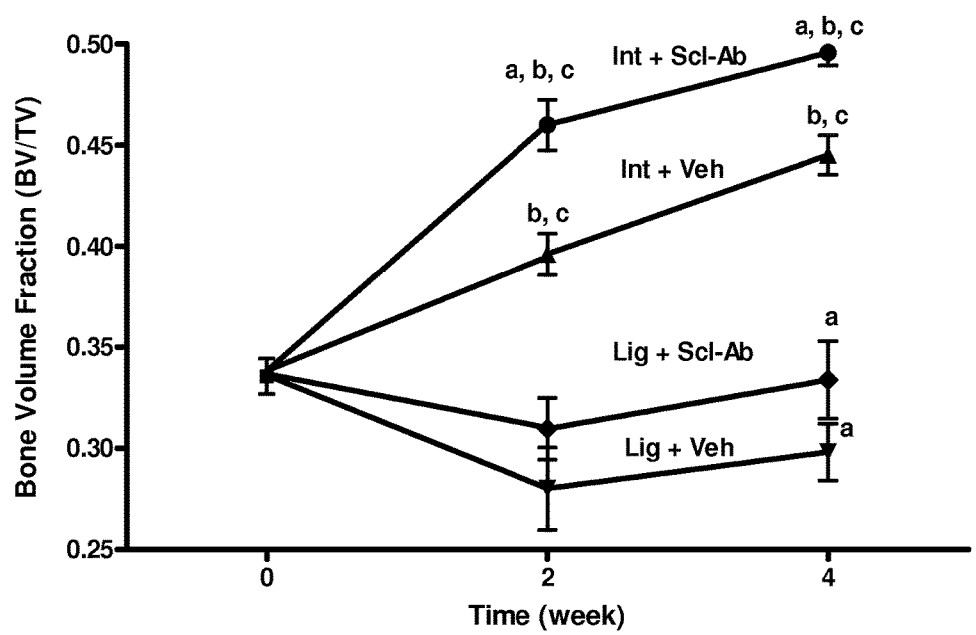
FIGS. 2A and 2B are graphs depicting the effect of system administration (measured at the 2-week and 4-week study endpoints) of an anti-sclerostin antibody on bone volume fraction (FIG. 2A) and bone mineral density (FIG. 2B) during experimental periodontitis.

The invention is predicated, at least in part, on the discovery that sclerostin inhibitors can treat alveolar bone loss associated with, for example, periodontal disease. In this regard, the invention provides a method of treating alveolar bone loss. The method comprises administering to a subject (e.g., a mammal, such as a human) one or more doses of a sclerostin inhibitor, such as sclerostin binding agent (e.g., an anti-sclerostin antibody or antibody fragment), during a treatment period in an amount effect to decrease the distance between the cement-enamel junction and the alveolar bone crest. The materials and methods of the invention are superior to existing therapies whose therapeutic efficacy relies upon invasive surgical methods (e.g., bone grafts) to restore the alveolar bone of the subject to pre-disease conditions (e.g., height and/or density and/or three-dimensional bone mass).

The alveolar bone loss for treatment by the methods described herein includes, but is not limited to, alveolar bone loss associated with periodontitis, tooth loss, tooth extraction, denture wearing, oral surgery, osteolmyelitis, osteoradionecrosis, developmental deformaties (e.g., defects at birth such as missing portions of the teeth, facial bones or jaw), sinus deficiencies, misalignment or trauma (e.g., avulsed tooth or jaw fracture). In some embodiments, the subject to be treated is suffering from advanced periodontitis.

The term "periodontal disease" as used herein is meant to encompass a spectrum of clinical conditions. The clinical diagnosis of periodontal disease is based on visual and radiographic assessment of the periodontal tissues and on measurements of the space between the tooth and the gum. In humans, these spaces are normally 1-3 mm in depth, and deepen as supporting connective tissue and bone are lost. During a comprehensive clinical examination, pocket depths and tissue support are measured at various locations (e.g., 4-6 locations) around every tooth and the amount of plaque, dental calculus, gingival bleeding and exudates are recorded. Dental radiographs are routinely used to assess the amount of bone support for the teeth.

The severity of the periodontal disease is usually based on the clinical attachment loss (CALs) measured from the cement-enamel junction or crown margin and may be considered mild (1-2 mm), moderate (3-4 mm), or severe (≥5 mm). The term "clinical attachment loss" (CAL) refers to the distance, measured in millimeters, from the cement-enamel junction (i.e. crown margin) to the apical gingival margin. Periodontal disease may also be characterized by pocket probing depths, with mild disease characterized by a periodontal pocket probing depth of about 4-5 mm, moderate disease characterized by pocket probing depths of about 6-7 mm and severe disease characterized by pocket probing depths of about ≥8 mm. The term periodontal "pocket probing depth" (PPD) refers to the distance, measured in millimeters, from the cement-enamel junction (i.e., crown margin) to the alveolar bone crest. Both PPD and CAL measurements are made with a periodontal probe at various sites around each tooth, for example the mesiobuccal or midbuccal sites. They provide a measure of the severity of periodontal disease. Alternatively, both PPD and CAL can be obtained from standard digital radiography with some anatomical landmarks.

Periodontal disease includes, but not limited to, plaque-induced and non-plaque-induced gingival diseases; chronic periodontitis (classified as slight (1-2 mm CAL), moderate (3-4 mm CAL), or severe (≥5 mm) of generalized or localized involvement; aggressive periodontitis (classified as (1-2 mm CAL), moderate (3-4 mm CAL), or severe (≥5 mm) of generalized or localized involvement); periodontitis as a manifestation of systemic diseases associated with hematologic disorders and genetic disorders; necrotizing periodontal diseases including necrotizing ulcerative gingivitis and necrotizing ulcerative periodontitis; abcesses of the periodontium including gingival, periodontal and pericoronal abscesses; periodontitis associated with endodontic lesions; and developmental or acquired deformities and conditions, for example, localized tooth-related factors that modify or predispose to plaque-induced gingival diseases or periodontitis, mucogingival deformities and conditions around teeth, and conditions on edentulous ridges and occlusal trauma. All of these conditions may be localized to one or a few specific teeth, or more generalized (i.e., ≥30% of sites are involved).

The term "advanced periodontal disease" as used herein refers to a subject presenting with a CAL of ≥5 mm or a periodontal PPD of ≥8 mm. Gingival recession, drifting of teeth, mobility and suppuration are signs that are often associated with advanced periodontal disease due to progressive destruction of the alveolar bone.

In some embodiments, the alveolar bone loss is produced by removal of sections of bone containing a benign tumor. Exemplary benign bone tumors include, but are not limited to, osteoma, osteoid osteoma, osteoblastoma, osteochondroma, enchondroma, chonrdomyxoid fibroma, aneurysmal bone cyst, unicameral bone cyst, fibrous dysplasia of bone and giant cell tumor of the bone.

Administration of the sclerostin inhibitor increases one or more parameters of alveolar bone (e.g., one or more of alveolar bone height, alveolar bone mass, alveolar bone density, alveolar bone volume, alveolar bone mineral content, and improved tooth stability). In this regard, "treating" alveolar bone loss includes, for example, any increase in alveolar bone height, alveolar bone mass, and alveolar bone density, as well as acceleration of alveolar bone repair. Similarly, "treating" alveolar bone loss includes mediating a level of alveolar bone repair beyond (i.e., greater than) the level of alveolar bone repair experienced in subjects (e.g., mammals, such as humans) not administered the sclerostin inhibitor (i.e., control subjects). Alveolar bone repair is evidenced by, for example, increased alveolar bone height, increased alveolar bone volume, increased alveolar bone mineral content and density, increased tooth stability or improved patient use of the affected area compared to such parameters prior to treatment. The increase in any one or more parameters of alveolar bone can be a return, in whole or in part, of the measured parameter to, e.g., (a) baseline level (e.g., the level prior to onset of disease), (b) values provided in normative databases or clinical standards used in the art, or (c) the contralateral functional level (e.g., return, in whole or in part, to the functional capabilities of, for example, non-diseased alveolar bone in the subject). In some cases, the increase can be an improvement beyond baseline level. If desired, the measured parameters in subjects administered one or more doses of the sclerostin inhibitor can be compared to the same parameters in other subjects presenting with alveolar bone loss (optionally age and gender matched) not administered the sclerostin inhibitor to further analyze the efficacy of the methods described herein.

Alveolar bone parameters (e.g., alveolar bone height, alveolar bone mass and/or alveolar bone density) may be measured using radiography (e.g., radiographic absorptometry), single- and/or dual-energy X-ray absorptometry, quantitative computed tomography (QCT), ultrasonography, radiography (e.g., radiographic absorptometry), and magnetic resonance imaging. In some embodiments, the amount of alveolar bone loss is identified and/or quantified by the periodontal pocket probing depth measurement.

In some embodiments, the sclerostin inhibitor (e.g., anti-sclerostin antibody or antibody fragment) is administered at a dose and for a time period effective to decrease the distance between the cement-enamel junction and the alveolar bone crest by at least 10% (e.g., at least 10%, at least 20%, at least 30%, at least 40%, at least 50%, at least 60%, at least 70%, at least 80%, at least 90% or more) compared to the pre-treatment distance or a control subject (i.e., a subject with similar disease state that did not receive treatment with the sclerostin inhibitor) by six weeks after initiation of treatment. In some embodiments, the distance between the cement-enamel junction and the alveolar bone crest is restored to the pre-disease state by six weeks after initiation of treatment. In some embodiments, the distance between the cement-enamel junction and the alveolar bone crest is less than or equal to about 2 mm (e.g., about 2 mm, about 1.9 mm, about 1.8 mm, about 1.7 mm, about 1.6 mm, about 1.5 mm, about 1.4 mm, about 1.3 mm, about 1.2 mm, about 1.1 mm or about 1 mm) by six weeks after initiation of treatment. In some or any embodiments, the distance between the cement-enamel junction and the alveolar bone crest is comparable to the distance in a non-diseased area of the subject's mouth (e.g., an adjacent or contralateral tooth) by six weeks after initiation of treatment.

In some embodiments, the sclerostin inhibitor (e.g., anti-sclerostin antibody or antibody fragment) is administered at a dose and for a time period effective to increase the alveolar bone height by at least 10% (e.g., at least 10%, at least 20%, at least 30%, at least 40%, at least 50%, at least 60%, at least 70%, at least 80%, at least 90% or more) compared to the pre-treatment alveolar bone height or a control subject (i.e., a subject with advanced periodontal disease that did not receive treatment with the sclerostin inhibitor) by six weeks after initiation of treatment. In some embodiments, the alveolar bone height is restored to pre-disease state alveolar bone height by six weeks after initiation of treatment. In some embodiments, the alveolar bone height is increased by at least 0.1 mm (e.g., at least about 0.1 mm, about 0.2 mm, about 0.3 mm, about 0.4 mm, about 0.5 mm, about 0.6 mm, about 0.7 mm, about 0.8 mm, about 0.9 mm, about 1 mm, about 1.5 mm, about 2 mm, about 2.5 mm, about 3 mm, about 3.5 mm, about 4 mm, about 4.5 mm, about 5 mm, about 5.5 mm, about 6 mm, about 6.5 mm, about 7 mm, about 7.5 mm, about 8 mm, about 8.5 mm, about 9 mm, about 9.5 about 10 mm) or more compared to pre-treatment alveolar bone height by six weeks after initiation of treatment. In some or any embodiments, the alveolar bone height is comparable to the distance in a non-diseased area of the subject's mouth (e.g., an adjacent or contralateral tooth) by six weeks after initiation of treatment.

In some embodiments, the sclerostin inhibitor (e.g., anti-sclerostin antibody or antibody fragment) is administered at a dose and for a time period effective to increase the alveolar bone density by at least 10% (e.g., at least 10%, at least 20%, at least 30%, at least 40%, at least 50%, at least 60%, at least 70%, at least 80%, at least 90% or more) compared to the pre-treatment alveolar bone density or a control subject (i.e., a subject with advanced periodontal disease that did not receive treatment with the sclerostin inhibitor) by six weeks after initiation of treatment. In some embodiments, the alveolar bone density is restored to pre-disease state alveolar bone density (e.g., of comparable density to a non-diseased gingival area of the subject's mouth) by six weeks after initiation of treatment. In humans, bone mineral density often is determined clinically using dual x-ray absorptiometry (DXA). Other techniques include quantitative computed tomography (QCT), ultrasonography, single-energy x-ray absorptiometry (SXA), magnetic resonance imaging, radiography, and radiographic absorptiometry. Except for ultra-sonography, the American Medical Association notes that BMD techniques typically involve the use of x-rays and are based on the principle that attenuation of the radiation depends on thickness and composition of the tissues in the radiation path. Often, techniques involve the comparison of results to a normative database.

Another parameter useful to assess successful treatment with a sclerostin inhibitor is alveolar bone volume fraction (BVF). The term "bone volume fraction" as used herein refers to the volume of mineralized bone per unit volume of the bone sample (BV/TV, %) and can be measured, for example, by micro-computed tomography (micro-CT). In some or any embodiments, the alveolar BVF is increased by at least 10% (e.g., at least 10%, at least 20%, at least 30%, at least 40%, at least 50%, at least 60%, at least 70%, at least 80%, at least 90% or more) compared to the pre-treatment alveolar BVF or compared to a control subject (i.e., a subject with advanced periodontal disease that did not receive treatment with the sclerostin inhibitor) by six weeks after initiation of treatment. In some or any embodiments, the alveolar BVF is comparable to the alveolar BVF in a non-diseased area of the subject's mouth (e.g., an adjacent or contralateral tooth) by six weeks after initiation of treatment.

The increase in any one or more of alveolar bone height, alveolar bone mass, alveolar bone density, and alveolar bone volume fraction and/or the decrease in the distance between the cement-enamel junction and the bone crest (or improvement of any other alveolar bone parameter) can be determined at 1 week, 2 weeks, 3 weeks, 4 weeks, 5 weeks, 6 weeks, 7 weeks, 8 weeks, 9 weeks, 10 weeks or more following the initial administration of sclerostin inhibitor. Alternatively, the increase in any one or more of alveolar bone height, alveolar bone mass, alveolar bone volume fraction and alveolar bone density (and/or the decrease in the distance between the cement-enamel junction and the bone crest) can be determined after the treatment period ends (e.g., 1 week, 2 weeks, 3 weeks, 4 weeks, 5 weeks, 6 weeks, 7 weeks, 8 weeks, 9 weeks, 10 weeks, 11 weeks, 12 weeks, 13 weeks, 14 weeks, 15 weeks, 16 weeks, 5 months, 6 months, 7 months, 8, months, 9 months, 10 months, 11 months or 1 year after the treatment period ends). In one aspect, the method reduces the amount of time required to establish a desired level of alveolar bone height, alveolar bone mass, alveolar bone density and/or alveolar bone volume fraction and/or the decrease in the distance between the cement-enamel junction and the bone crest, e.g., any percent increase in alveolar bone height, alveolar bone mass or alveolar bone density and/or alveolar bone volume fraction, and/or distance between the cement-enamel junction and the bone crest described herein compared to age and gender-matched patients that do not receive the sclerostin inhibitor, thereby reducing recovery time for a subject. For example, in one embodiment, the sclerostin inhibitor reduces the amount of time required to increase alveolar bone height, alveolar bone mass, alveolar bone density and/or alveolar bone volume fraction and/or the decrease in the distance between the cement-enamel junction and the bone crest at least about 10% (e.g., at least about 20%, at least about 25%, at least about 30%, at least about 35%, at least about 40%, at least about 45%, or at least about 50%) compared to subject not receiving the sclerostin inhibitor.

Functional, quality of life parameters indicative of enhanced alveolar bone include, but are not limited to, decreased risk of tooth loss; decreased bleeding of the gums, reduced depth of the periodontal pocket, increased level of gingival tissue attachment, improved pronunciation; improved sense of taste; increased ability to eat certain foods; decreased tension; improved diet and decreased irritability. Administration of one or more doses of a sclerostin inhibitor, as described herein, accelerates improvement of functional, quality of life parameters associated with alveolar bone loss in a statistically significant manner in the patient population tested.

In some embodiments, one or more doses of a sclerostin inhibitor, such as a sclerostin binding agent (e.g., an anti-sclerostin antibody or antibody fragment) is administered to a human over the course of a treatment period comprising 1, 2, 3, 4, 5, 6, 7, 8, 9, 10, 11, 12, 13, 14, 15, 16, 17, 18, 19, 20, 21, 22, 23, 24, 25, 26, 27, 28, 29, 31 weeks, 8 months, 9 months, 10 months, 11 months, 1 year, 18 months or longer. A "treatment period" begins upon administration of a first dose of sclerostin inhibitor (e.g., anti-sclerostin antibody or antibody fragment) and ends upon administration of a final dose of sclerostin inhibitor. Any number of administrations of sclerostin inhibitor during a treatment period is contemplated. For example, 1, 2, 3, 4, 5, 6, 7, 8, 9, 10, 11, 12, 13, 14, 15, 16, 17, 18, 19, 20 doses or administrations of the sclerostin inhibitor is provided to the subject over the treatment period. In one embodiment, the treatment period comprises at least 6 weeks. In some embodiments, the treatment period lasts at least 28 weeks. In other embodiments, the treatment period lasts at least 1 year. Alternatively or in addition, the treatment period lasts no more than 18 months. Indeed, one or more administrations of a pharmaceutical composition comprising the sclerostin inhibitor may be carried out over a treatment or therapeutic period lasting no more than 18 months, less than 1 year, no more than 8 months, no more than 28 weeks, or no more than 20 weeks. In one embodiment, the treatment period is about 28 weeks and yields significant improvement in alveolar bone parameters, such as (but not limited to) alveolar bone height, alveolar bone mass, alveolar bone volume fraction and alveolar bone density compared to untreated subjects with alveolar bone loss.

The sclerostin binding agent (e.g., anti-sclerostin antibody or antibody fragment) is administered in an amount that promotes, enhances, or accelerates repair of the alveolar bone. In any embodiment, the sclerostin inhibitor may be administered to a subject (e.g., a human subject) in an amount from about 5 milligrams to about 1,000 milligrams of sclerostin inhibitor per week. For example, the amount of sclerostin inhibitor (e.g., anti-sclerostin antibody or antibody fragment) can comprise at least about 5 mg, 15 mg, 25 mg, 50 mg, about 60 mg, about 70 mg, about 80 mg, about 90 mg, about 100 mg, about 120 mg, about 140 mg, about 150 mg, about 170 mg, about 180 mg, about 200 mg, about 210 mg, about 240 mg, about 250 mg, about 270 mg, about 280 mg, about 300 mg, about 350 mg, about 400 mg, about 420 mg, about 450 mg, about 500 mg, about 550 mg, about 600 mg, about 650 mg, about 700 mg, about 750 mg, about 800 mg, about 850 mg, about 900 mg, about 950 mg or up to about 1,000 mg of sclerostin inhibitor. Ranges between any and all of these endpoints are also contemplated, e.g. about 50 mg to about 80 mg, about 70 mg to about 140 mg, about 70 mg to about 210 mg, about 75 mg to about 100 mg, about 100 mg to about 150 mg, about 120 mg to about 270 mg, about 140 mg to about 210 mg, or about 150 mg to about 200 mg, or about 280 to about 410 mg. A dose is administered at any interval, such as multiple times a week (e.g., twice or three times per week), once a week, once every two weeks, once every three weeks, or once every four weeks. In some or any embodiments, a dose of sclerostin inhibitor (e.g., anti-sclerostin antibody or antibody fragment) ranging from about 120 mg to about 210 mg is administered twice a week. In some or any embodiments, a dose of about 140 mg of the sclerostin inhibitor (e.g., anti-sclerostin antibody or antibody fragment) is administered twice a week. In some or any embodiments, the treatment period is 12 weeks and the sclerostin is administered on week 2, week 6 and week 12 of the treatment period, optionally at a dose of about 140 mg. Any of the doses described herein may be administered as divided doses. For example, a dose of 140 mg of sclerostin inhibitor may be administered as two injections of 70 mg of sclerostin inhibitor or seven injections of 20 mg of sclerostin inhibitor during a dentist visit.

In some embodiments, the dose of sclerostin binding agent administered to a subject (e.g., a mammal, such as a human) may range from about 0.1 mg/kg to about 100 mg/kg, or about 10 mg/kg to about 50 mg/kg of body weight. For example, the dose of sclerostin inhibitor (e.g., sclerostin binding agent) may range from about 0.1 mg/kg, about 0.5 mg/kg, about 1 mg/kg, about 2 mg/kg, about 3 mg/kg, about 4 mg/kg about 5 mg/kg, about 6 mg/kg, about 7 mg/kg, about 8 mg/kg, about 9 mg/kg, about 10 mg/kg, about 20 mg/kg, about 25 mg/kg, about 26 mg/kg, about 27 mg/kg, about 28 mg/kg, about 29 mg/kg, about 30 mg/kg, about 31 mg/kg, about 32 mg/kg, about 33 mg/kg, about 34 mg/kg, about 35 mg/kg, about 36 mg/kg, about 37 mg/kg, about 38 mg/kg, about 39 mg/kg, about 40 mg/kg, about 41 mg/kg, about 42 mg/kg, about 43 mg/kg, about 44 mg/kg, about 45 mg/kg, about 46 mg/kg, about 47 mg/kg, about 48 mg/kg, about 49 mg/kg, or about 50 mg/kg, about 55 mg/kg, about 60 mg/kg, about 65 mg/kg, about 70 mg/kg, about 75 mg/kg, about 80 mg/kg, about 85 mg/kg, about 90 mg/kg, or about 95 mg/kg, up to about 100 mg/kg of body weight.

In addition, it may be advantageous to administer multiple doses of a sclerostin binding agent or space out the administration of doses, depending on the therapeutic regimen selected for a particular patient. For example, a dose of sclerostin inhibitor can be administered once every four weeks, once every three weeks, once every two weeks, once a week, or multiple times a week (e.g., twice a week, three times a week, four times a week, or more), depending on the severity of the disease state, the age and physical health of the patient, and the like.

In some embodiments, the subject optionally suffers from a bone-related disorder selected from the group consisting of advanced periodontal disease, achondroplasia, postmenopausal bone loss, oral bone loss, osteonecrosis of the jaw, and jaw bone loss associated with aging. Optionally, the subject is undergoing or has undergone oral or maxillofacial surgery.

In some embodiments, the subject optionally suffers from a secondary condition selected from the group consisting of juvenile Paget's disease, melorheostosis, metabolic bone diseases, mastocytosis, sickle cell anemia/disease, organ transplant related bone loss, kidney transplant related bone loss, systemic lupus erythematosus, ankylosing spondylitis, epilepsy, juvenile arthritides, thalassemia, mucopolysaccharidoses, Fabry Disease, Turner Syndrome, Down Syndrome, Klinefelter Syndrome, leprosy, Perthe's Disease, adolescent idiopathic scoliosis, infantile onset multi-system inflammatory disease, Winchester Syndrome, Menkes Disease, Wilson's Disease, ischemic bone disease (such as Legg-Calve-Perthes disease and regional migratory osteoporosis), anemic states, conditions caused by steroids, glucocorticoid-induced bone loss, heparin-induced bone loss, bone marrow disorders, scurvy, malnutrition, calcium deficiency, osteoporosis, osteopenia, alcoholism, chronic liver disease, postmenopausal state, chronic inflammatory conditions, rheumatoid arthritis, inflammatory bowel disease, ulcerative colitis, inflammatory colitis, Crohn's disease, oligomenorrhea, amenorrhea, pregnancy, diabetes mellitus, hyperthyroidism, thyroid disorders, parathyroid disorders, Cushing's disease, acromegaly, hypogonadism, immobilization or disuse, reflex sympathetic dystrophy syndrome, regional osteoporosis, osteomalacia, bone loss associated with joint replacement, HIV associated bone loss, bone loss associated with loss of growth hormone, bone loss associated with cystic fibrosis, chemotherapy-associated bone loss, tumor-induced bone loss, cancer-related bone loss, hormone ablative bone loss, multiple myeloma, drug-induced bone loss, anorexia nervosa, disease-associated facial bone loss, disease-associated cranial bone loss, disease-associated bone loss of the jaw, disease-associated bone loss of the skull, bone loss associated with aging, facial bone loss associated with aging, cranial bone loss associated with aging, cleidocranial dysostosis, enchondromatosis, fibrous dysplasia, Gaucher's Disease, hypophosphatemic rickets, Marfan's syndrome, multiple hereditary exotoses, neurofibromatosis, osteogenesis imperfecta, osteopetrosis, osteopoikilosis, sclerotic lesions, pseudoarthrosis, pyogenic osteomyelitis, periodontal disease, anti-epileptic drug induced bone loss, primary and secondary hyperparathyroidism, familial hyperparathyroidism syndromes, weightlessness induced bone loss, osteoporosis in men, osteoarthritis, renal osteodystrophy, infiltrative disorders of bone, skull bone loss associated with aging and bone loss associated with space travel.

In some embodiments, the subject is optionally suffering from (or has suffered from) a cancer. The term "cancer" refers to a proliferative disorder associated with uncontrolled cell proliferation, unrestrained cell growth, and decreased cell death/apoptosis. Cancer includes, but is not limited to, breast cancer, prostate cancer, lung cancer, kidney cancer, thyroid cancer, melanoma, follicular lymphomas, carcinomas with p53 mutations, and hormone-dependent tumors, including, but not limited to, colon cancer, cardiac tumors, pancreatic cancer, retinoblastoma, glioblastoma, intestinal cancer, testicular cancer, stomach cancer, neuroblastoma, myxoma, myoma, lymphoma, endothelioma, osteoblastoma, osteoclastoma, osteosarcoma, chondrosarcoma, adenoma, Kaposi's sarcoma, ovarian cancer, leukemia (including acute leukemias (for example, acute lymphocytic leukemia, acute myelocytic leukemia, including myeloblastic, promyelocytic, myelomonocytic, monocytic, and erythroleukemia)) and chronic leukemias (for example, chronic myelocytic (granulocytic) leukemia and chronic lymphocytic leukemia), myelodysplastic syndrome polycythemia vera, lymphomas (for example, Hodgkin's disease and non-Hodgkin's disease), multiple myeloma, Waldenstrom's macroglobulinemia, heavy chain diseases, and solid tumors including, but not limited to, sarcomas and carcinomas such as fibrosarcoma, myxosarcoma, liposarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, and menangioma. The terms "metastasis" and "cancer metastasis" are used interchangeably herein to refer to the ability of a cancer cell to spread to other tissues. For example, "metastasis to bone" refers to the ability of certain types of cancer including, but not limited to, breast, prostate, lung, kidney, thyroid, and melanoma, to metastasize to bone.

The methods described herein are also applicable to other forms of periodontal disease including periodontal disease associated with systemic disorders such as cardiovascular disease, stroke, pulmonary disease, inflammatory diseases and systemic lupus erythematosus; periodontal disease associated with metabolic disorders such as diabetes mellitus, and periodontal disease associated with hormonal alterations associated with, for example, menopause. Use of certain drugs such as anticonvulsants, calcium channel blockers, and cyclosporine, may also elevate the risk of gingival hyperplasia or periodontal disease, as does certain hematologic disorders including immune system disorders caused by, for example, HIV. The treatment of subjects suffering from or at risk of suffering from the aforementioned disorders with a sclerostin inhibitor described herein is specifically contemplated.

In some embodiments, the subject optionally suffers from an osteolytic disorder. The term "osteolytic disorder" as used herein refers to any condition that is caused by an increase in the activity of osteoclasts, which are cells responsible for bone resorption. The terms "osteolysis" and "osteolytic bone loss" are used interchangeably to refer to osteoclast-mediated bone resorption or bone loss associated with an osteolytic disorder. Osteolytic disorders occur in subjects with a predisposition to develop an osteolytic disorder, or they occur in subjects with a disease that leads to or contributes to an osteolytic disorder by stimulating osteoclast activity. In some embodiments, the osteolytic disorder is osteolytic bone loss. In other embodiments, the osteolytic disorder is cancer metastasis-induced osteolytic bone loss. In further embodiments, the osteolytic bone disorder is a metabolic bone disease, including but not limited to, endocrinopathies (e.g., hypercortisolism, hypogonadism, primary or secondary hyperparathyroidism, and hyperthyroidism); dietary deficiency, including but not limited to, rickets, osteomalacia, scurvy, and malnutrition; osteoporosis; drug use, including glucocorticoids (glucocorticoid-induced osteoperosis), heparin, and alcohol; chronic disease, including malabsorption syndromes; chronic renal failure, including renal osteodystrophy; chronic liver disease, including hepatic osteodystrophy; inherited disease, including osteogenesis imperfecta and homocystinuria; and bone inflammation associated with arthritis, rheumatoid arthritis, psoriatic arthritis, fibrous dysplasia, periodontal disease, and Paget's disease.

The terms "metastasis-induced osteolytic bone loss," and "cancer metastasis-induced osteolytic bone loss," are used interchangeably herein to refer to osteolysis or osteolytic bone loss resulting from cancer cell metastasis to bone. The term "cancer metastasis-induced osteoclast activation" is used herein to refer to the ability of cancer cells that have metastasized to bone to induce the activation of osteoclasts.

The methods described herein comprise administering an amount of a "sclerostin inhibitor." As used herein, the term "sclerostin inhibitor" means any molecule that inhibits the biological activity of sclerostin on bone, as measured by changes to bone mineralization, bone density, bone height, effect on osteoblasts and/or osteoclasts, markers of bone formation, markers of bone resorption, markers of osteoblast activity, and/or markers of osteoclast activity. Such inhibitors may act by binding to sclerostin or its receptor or binding partner. Inhibitors in this category include "sclerostin binding agents," such as, e.g., antibodies or peptide-based molecules. "Sclerostin inhibitors" also refers to small organic chemical compounds, optionally of less than about 1000 Daltons in molecular weight that bind sclerostin and inhibit its activity. Inhibitors may alternatively act by inhibiting expression of sclerostin. Inhibitors in this category include polynucleotides or oligonucleotides that bind to sclerostin DNA or mRNA and inhibit sclerostin expression, including, but not limited to, an antisense oligonucleotide, inhibitory RNA, DNA enzyme (deoxyribozyme), ribozyme, an aptamer or pharmaceutically acceptable salts thereof that inhibit the expression of sclerostin.

A "sclerostin binding agent" binds to sclerostin or portions thereof to block or impair binding of human sclerostin to one or more ligands. Sclerostin, the product of the SOST gene, is absent in sclerosteosis, a skeletal disease characterized by bone overgrowth and strong dense bones (Brunkow et al., *Am. J. Hum. Genet.*, 68:577-589 (2001); Balemans et al., *Hum. Mol. Genet.*, 10:537-543 (2001)). The amino acid sequence of human sclerostin is reported by Brunkow et al. and is disclosed in U.S. Patent Publication No. 20070110747 as SEQ ID NO: 1 (which patent publication is incorporated in its entirety for its description of sclerostin binding agents and Sequence Listing). Recombinant human sclerostin/ SOST is commercially available from R&D Systems (Minneapolis, Minn., USA; 2006 Catalog #1406-ST-025). Additionally, recombinant mouse sclerostin/SOST is commercially available from R&D Systems (Minneapolis, Minn., USA; 2006 Catalog #1589-ST-025). Research grade sclerostin-binding monoclonal antibodies are commercially available from R&D Systems (Minneapolis, Minn., USA; mouse monoclonal: 2006 Catalog # MAB1406; rat monoclonal: 2006 Catalog # MAB1589). U.S. Pat. Nos. 6,395,511 and 6,803,453, and U.S. Patent Publication Nos. 20040009535 and 20050106683 refer to anti-sclerostin antibodies generally. Examples of sclerostin binding agents suitable for use in the context of the invention also are described in U.S. Patent Publication Nos. 20070110747 and 20070072797, which are hereby incorporated by reference. Additional information regarding materials and methods for generating sclerostin binding agents can be found in U.S. Patent Publication No. 20040158045 (hereby incorporated by reference).

The sclerostin binding agent of the invention preferably is an antibody. The term "antibody" refers to an intact antibody, or a binding fragment thereof. An antibody may comprise a complete antibody (immunoglobulin) molecule (including polyclonal, monoclonal, chimeric, humanized, and/or human versions having full length heavy and/or light chains), or comprise an antigen binding fragment thereof. Antibody fragments include F(ab')$_2$, Fab, Fab', Fv, Fc, and Fd fragments, and can be incorporated into single domain antibodies (e.g., nanobodies), single-chain antibodies, maxibodies, minibodies, intrabodies, diabodies, triabodies, tetrabodies, v-NAR and bis-scFv (see, e.g., Hollinger and Hudson, *Nature Biotechnology*, 23(9):1126-1136 (2005)). Antibody polypeptides, including fibronectin polypeptide monobodies, also are disclosed in U.S. Pat. No. 6,703,199. Other antibody polypeptides are disclosed in U.S. Patent Publication No. 20050238646. U.S. Pat. Nos. 6,395,511 and 6,803,453, and U.S. Patent Publication Nos. 20040009535 and 20050106683 (incorporated in their entirety by reference for their disclosure of anti-sclerostin antibodies) refer to anti-sclerostin antibodies generally. The amino acid sequence of human sclerostin is set forth in SEQ ID NO: 1 of the Sequence Listing and is provided as SEQ ID NO: 1 of U.S. Patent Publication No. 20070110747 (which patent publication is incorporated in its entirety for its description of sclerostin and sclerostin binding agents and Sequence Listing). Additional information regarding materials and methods for generating anti-sclerostin antibodies can be found in U.S. Patent Publication No. 20040158045 (hereby incorporated by reference in its entirety).

An antibody fragment may be a synthetic or genetically engineered protein. For example, antibody fragments include isolated fragments consisting of the light chain variable region, "Fv" fragments consisting of the variable regions of the heavy and light chains, and recombinant single chain polypeptide molecules in which light and heavy variable regions are connected by a peptide linker (scFv proteins).

Another form of an antibody fragment is a peptide comprising one or more complementarity determining regions (CDRs) of an antibody. CDRs (also termed "minimal recognition units" or "hypervariable region") are obtained by, e.g., constructing polynucleotides that encode the CDR of interest. Such polynucleotides are prepared, for example, by using the polymerase chain reaction to synthesize the variable region using mRNA of antibody-producing cells as a template (see, for example, Larrick et al., *Methods: A Companion to Methods in Enzymology*, 2:106 (1991); Courtenay-Luck, "Genetic Manipulation of Monoclonal Antibodies," in *Monoclonal Antibodies Production, Engineering and Clinical Application*, Ritter et al. (eds.), page 166, Cambridge University Press (1995); and Ward et al., "Genetic Manipulation and Expression of Antibodies," in *Monoclonal Antibodies: Principles and Applications*, Birch et al., (eds.), page 137, Wiley-Liss, Inc. (1995)).

Anti-sclerostin antibodies may bind to sclerostin of SEQ ID NO: 1, or a naturally occurring variant thereof, with an affinity (Kd) of less than or equal to $1 \times 10^{-7}$M, less than or equal to $1 \times 10^{-8}$M, less than or equal to $1 \times 10^{-9}$M, less than or equal to $1 \times 10^{-10}$M, less than or equal to $1 \times 10^{-11}$M, or less than or equal to $1 \times 10^{-12}$M. Affinity is determined using a variety of techniques, an example of which is an affinity ELISA assay. In various embodiments, affinity is determined by a BIAcore assay. In various embodiments, affinity is determined by a kinetic method. In various embodiments, affinity is determined by an equilibrium/solution method. U.S. Patent Publication No. 20070110747 contains additional description of affinity assays suitable for determining the affinity (Kd) of an antibody for sclerostin.

In some or any embodiments, the anti-sclerostin antibody or antibody fragment binds to a sclerostin polypeptide comprising the amino acid sequence set forth in SEQ ID NO: 1 and binds the sequence of SEQ ID NO: 6 (CG-PARLLPNAIGRGKWWRPSGPDFRC; corresponding to amino acids 86-111 of SEQ ID NO: 1). Alternatively or in addition, the anti-sclerostin antibody binds to a sclerostin polypeptide comprising amino acids 57-146 of SEQ ID NO: 1. Alternatively or in addition, the anti-sclerostin antibody binds to a sclerostin polypeptide comprising amino acids 89-103 of SEQ ID NO: 1 and/or amino acids 137-151 of SEQ ID NO: 1. Alternatively or in addition, the anti-sclerostin antibody binds to a sclerostin polypeptide comprising the amino acid sequence set forth in SEQ ID NO: 1 and binds the sequence of at least one of SEQ ID NO: 2 (DVSEYSCRELHFTR; corresponding to amino acids 51-64 of SEQ ID NO: 1), SEQ ID NO: 3 (SAKPVTELVC-SGQCGPAR; corresponding to amino acids 73-90 of SEQ ID NO: 1), SEQ ID NO: 4 (WWRPSGPDFRCIPDRYR; corresponding to amino acids 101-117 of SEQ ID NO: 1), SEQ ID NO: 5 (LVASCKCKRLTR; corresponding to amino acids 138-149 of SEQ ID NO: 1), SEQ ID NO: 70 (SAK-PVTELVCSGQC; corresponding to amino acids 73-86 of SEQ ID NO: 1), SEQ ID NO: 71 (LVASCKC; corresponding to amino acids 138-144 of SEQ ID NO: 1), SEQ ID NO: 72 (C1RELHFTR; corresponding to amino acids 57-64 of SEQ ID NO: 1), or SEQ ID NO: 73 (CIPDRYR; corresponding to amino acids 111-117 of SEQ ID NO: 1) within SEQ ID NO: 1. For example, in one aspect, the anti-sclerostin antibody binds a subregion of sclerostin of SEQ ID NO: 1 comprising SEQ ID NOs: 2-5 (and/or SEQ ID NOs: 70-73), optionally in its native three-dimensional conformation. Optionally, the anti-sclerostin antibody binds a peptide consisting of one or more of SEQ ID NO: 2, SEQ ID NO: 3, SEQ ID NO: 4, SEQ ID NO: 5, SEQ ID NO: 6, SEQ ID NO: 70, SEQ ID NO: 71, SEQ ID NO: 72, or SEQ ID NO: 73 (e.g., a peptide consisting of SEQ ID NO: 2, SEQ ID NO: 3, SEQ ID NO: 4, and SEQ ID NO: 5 or a peptide consisting of SEQ ID NO: 70, SEQ ID NO: 71, SEQ ID NO: 72, and SEQ ID NO: 73).

In some or any embodiments, the anti-sclerostin antibody binds to a sclerostin polypeptide having the amino acid sequences of SEQ ID NO:2, SEQ ID NO:3, SEQ ID NO:4 and SEQ ID NO:5, wherein SEQ ID NO:2 and 4 are joined by a disulfide bond at amino acid positions 57 and 111 with reference to SEQ ID NO:1, and SEQ ID NO:3 and 5 are joined by at least one of (a) a disulfide bond at amino acid positions 82 and 142 with reference to SEQ ID NO:1, and (b) a disulfide bond at amino acid positions 86 and 144 with reference to SEQ ID NO:1; the polypeptide may retain the tertiary structure of the corresponding polypeptide region of human sclerostin of SEQ ID NO:1. Alternatively or in addition, the sclerostin binding agent (e.g., anti-sclerostin antibody) binds a polypeptide having the amino acid sequences of SEQ ID NO: 70, SEQ ID NO: 71, SEQ ID NO: 72 and SEQ ID NO: 73, wherein SEQ ID NO: 72 and 73 are joined by a disulfide bond at amino acid positions 57 and 111 with reference to SEQ ID NO: 1, and SEQ ID NO: 70 and 71 are joined by at least one of (a) a disulfide bond at amino acid positions 82 and 142 with reference to SEQ ID NO: 1, and (b) a disulfide bond at amino acid positions 86 and 144 with reference to SEQ ID NO: 1.

Optionally, the anti-sclerostin antibody binds a peptide consisting essentially of the amino acid sequences of SEQ ID NO: 2, SEQ ID NO: 3, SEQ ID NO: 4 and SEQ ID NO: 5, wherein SEQ ID NO: 2 and 4 are joined by a disulfide bond at amino acid positions 57 and 111 with reference to SEQ ID NO: 1, and SEQ ID NO: 3 and 5 are joined by at least one of (a) a disulfide bond at amino acid positions 82 and 142 with reference to SEQ ID NO: 1, and (b) a disulfide bond at amino acid positions 86 and 144 with reference to SEQ ID NO: 1.

Optionally, the anti-sclerostin antibody binds to a polypeptide consisting essentially of a multiply truncated human sclerostin protein of SEQ ID NO: 1, wherein (a) amino acids 1-50, 65-72, 91-100, 118-137, and 150-190 of SEQ ID NO: 1 are absent from said polypeptide or (b) amino acids 1-56, 65-72, 87-110, 118-137, and 145-190 of SEQ ID NO: 1 are absent from said polypeptide.

In some or any embodiments, the anti-sclerostin antibody binds to a polypeptide having the amino acid sequences of SEQ ID NO: 70, SEQ ID NO: 71, SEQ ID NO: 72 and SEQ ID NO: 73, wherein SEQ ID NO: 72 and 73 are joined by a disulfide bond at amino acid positions 57 and 111 with reference to SEQ ID NO: 1, and SEQ ID NO: 70 and 71 are joined by at least one of (a) a disulfide bond at amino acid positions 82 and 142 with reference to SEQ ID NO: 1, and (b) a disulfide bond at amino acid positions 86 and 144 with reference to SEQ ID NO: 1.

In some or any embodiments, the polypeptide retains the tertiary structure of the corresponding polypeptide region of human sclerostin of SEQ ID NO: 1.

In some or any embodiments, the anti-sclerostin antibody that binds to (i) a portion of human sclerostin comprising amino acids 51-64, 73-90, 101-117, and 138-149 of SEQ ID NO: 1, wherein said portion has at least one, at least two or all three of:

(a) a disulfide bond between amino acids 57 and 111;
(b) a disulfide bond between amino acids 82 and 142; and
(c) a disulfide bond between amino acids 86 and 144; or (ii) a portion of human sclerostin comprising amino acids 57-64, 73-86, 111-117, and 138-144 of SEQ ID NO: 1, wherein said portion has at least one, at least two, or all three of:

(a) a disulfide bond between amino acids 57 and 111;
(b) a disulfide bond between amino acids 82 and 142; and
(c) a disulfide bond between amino acids 86 and 144.

In some or any embodiments, the anti-sclerostin antibody also binds to an epitope of SEQ ID NO: 6.

Anti-sclerostin antibodies for use in the methods described herein preferably modulate sclerostin function in the cell-based assay described in U.S. Patent Publication No. 2007/0110747 and/or the in vivo assay described in U.S. Patent Publication No. 20070110747 and/or bind to one or more of the epitopes described in U.S. Patent Publication No. 2007/0110747 and/or cross-block the binding of one of the antibodies described in U.S. Patent Publication No. 2007/0110747 and/or are cross-blocked from binding sclerostin by one of the antibodies described in U.S. Patent Publication No. 2007/0110747 (incorporated by reference in its entirety and for its description of assays for characterizing an anti-sclerostin antibody).

In various aspects, the anti-sclerostin antibody is capable of neutralizing human sclerostin in a MC3T3 cell-based mineralization assay when there is less than a 6-fold excess of moles of sclerostin binding sites per well as compared to the number of moles of sclerostin per well. Mineralization by osteoblast-lineage cells in culture, either primary cells or cell lines, is used as an in vitro model of bone formation. An exemplary cell-based mineralization assay is described in U.S. Patent Publication No. 20070110747 at, e.g., Example 8 (hereby incorporated by reference). MC3T3-E1 cells (Sudo et al., J. Cell Biol., 96:191-198 (1983)) and subclones of the original cell line can form mineral in culture upon growth in the presence of differentiating agents. Such subclones include MC3T3-E1-BF (Smith et al., J. Biol. Chem., 275:19992-20001 (2000)). For both the MC3T3-E1-BF subclone as well as the original MC3T3-E1 cells, sclerostin can inhibit one or more of the sequence of events leading up to and including mineral deposition (i.e., sclerostin inhibits mineralization). Anti-sclerostin antibodies that are able to neutralize sclerostin's inhibitory activity allow for mineralization of the culture in the presence of sclerostin such that there is a statistically significant increase in, e.g., deposition of calcium phosphate (measured as calcium) as compared to the amount of calcium measured in the sclerostin-only (i.e., no antibody) treatment group.

When running the assay with the goal of determining whether a particular anti-sclerostin antibody (or other sclerostin inhibitor) can neutralize sclerostin, the amount of sclerostin used in the assay desirably is the minimum amount of sclerostin that causes at least a 70%, statistically significant, reduction in deposition of calcium phosphate (measured as calcium) in the sclerostin-only group, as compared to the amount of calcium measured in the no sclerostin group. An anti-sclerostin neutralizing antibody is defined as one that causes a statistically significant increase in deposition of calcium phosphate (measured as calcium) as compared to the amount of calcium measured in the sclerostin-only (i.e., no antibody) treatment group. To determine whether an anti-sclerostin antibody is neutralizing or not, the amount of anti-sclerostin antibody used in the assay needs to be such that there is an excess of moles of sclerostin binding sites per well as compared to the number of moles of sclerostin per well. Depending on the potency of the antibody, the fold excess that may be required can be 24, 18, 12, 6, 3, or 1.5, and one of skill is familiar with the routine practice of testing more than one concentration of binding agent (antibody). For example, a very potent anti-sclerostin neutralizing antibody will neutralize sclerostin when there is less than a 6-fold excess of moles of sclerostin binding sites per well as compared to the number of moles of sclerostin per well. A less potent anti-sclerostin neutralizing antibody will neutralize sclerostin only at a 12, 18 or 24 fold excess.

The anti-sclerostin antibody optionally has an $IC_{50}$ of 100 nM or less, or 75 nM or less, or 50 nM or less, or 25 nM or less for neutralizing human sclerostin in a cell-based assay, such as a bone specific alkaline phosphatase assay, e.g., the bone specific alkaline phosphatase assay described in International Patent Publication No. WO 2008/115732 and U.S. Pat. No. 7,744,874 (incorporated herein by reference in its entirety for its description of cell-based assays and anti-sclerostin antibodies). The bone specific alkaline phosphatase assay is predicated on the ability of sclerostin to decrease BMP-4 and Wnt3a-stimulated alkaline phosphatase levels in the multipotential murine cell line, C2C12. According to WO 2008/115732, a neutralizing anti-sclerostin antibody mediates a dose-dependent increase of alkaline phosphatase activity in this assay. Exemplary protocols of the cell-based assays are provided in Example 1.

Alternatively or in addition, the anti-sclerostin antibody has an $IC_{50}$ of 100 nM or less (e.g., 75 nM or less, or 50 nM or less) for neutralizing human sclerostin in a cell-based Wnt signaling assay in HEK293 cell lines, such as the Wnt assay involving Wnt1-mediated induction of STF reporter gene described in e.g., International Patent Publication No. WO 2009/047356 (incorporated by reference for its discussion of anti-sclerostin antibodies and cell-based assays). Alternatively or in addition, the anti-sclerostin antibody has an $IC_{50}$ of 500 nM or less (e.g., 250 nM or less, 150 nM or less, 100 nM or less, or 50 nM or less) for neutralizing human sclerostin in a BMP2-induced mineralization assay in MC3T3 cells, such as the mineralization assay described in e.g., International Patent Publication No. WO 2009/047356. An exemplary protocol is provided in Example 1.

Examples of anti-sclerostin antibodies suitable for use in the context of the invention are described in U.S. Patent Publication Nos. 2007/0110747 and 2007/0072797, which are hereby incorporated by reference. In one embodiment of the invention, the anti-sclerostin antibody cross-blocks the binding of at least one of antibodies Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, and Ab-24 (all of which are described in U.S. Patent Publication No. 20070110747) to sclerostin. Alternatively or in addition, the anti-sclerostin antibody is cross-blocked from binding to sclerostin by at least one of antibodies Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, and Ab-24 (all of which are described in U.S. Patent Publication No. 20070110747). The terms "cross-block," "cross-blocked," and "cross-blocking" are used interchangeably herein to mean the ability of an antibody to interfere with the binding of other antibodies to sclerostin. The extent to which an antibody is able to interfere with the binding of another to sclerostin, and therefore whether it can be said to cross-block, can be determined using competition binding assays. In some aspects of the invention, a cross-blocking antibody or fragment thereof reduces sclerostin binding of a reference antibody between about 40% and about 100%, such as about 60% and about 100%, specifically between 70% and 100%, and more specifically between 80% and 100%. A particularly suitable quantitative assay for detecting cross-blocking uses a Biacore machine which measures the extent of interactions using surface plasmon resonance technology. Another suitable quantitative cross-blocking assay uses an ELISA-based approach to measure competition between antibodies in terms of their binding to sclerostin.

In some or any embodiments, the anti-sclerostin antibody cross-blocks the binding of an immunoglobulin comprising full length heavy and light chains to sclerostin of SEQ ID NO: 1 and/or is cross-blocked from binding to sclerostin of SEQ ID NO: 1 by an immunoglobulin comprising full length heavy and light chains, wherein the immunoglobulin comprising full length heavy and light chains comprise CDR sequences disclosed herein, such as one of the following three sets of CDR sequences: a) CDR-L1 of SEQ ID NO: 284, CDR-L2 of SEQ ID NO: 285, CDR-L3 of SEQ ID NO: 286, CDR-H1 of SEQ ID NO: 296, CDR-H2 of SEQ ID NO: 297, and CDR-H3 of SEQ ID NO: 298; b) CDR-L1 of SEQ ID NO: 48, CDR-L2 of SEQ ID NO: 49, CDR-L3 of SEQ ID NO: 50, CDR-H1 of SEQ ID NO: 45, CDR-H2 of SEQ ID NO: 46, and CDR-H3 of SEQ ID NO: 47; or c) CDR-L1 of SEQ ID NO: 42, CDR-L2 of SEQ ID NO: 43, CDR-L3 of SEQ ID NO: 44, CDR-H1 of SEQ ID NO: 39, CDR-H2 of SEQ ID NO: 40, and CDR-H3 of SEQ ID NO: 41. Alternatively, or in addition, the anti-sclerostin antibody cross-blocks the binding of immunoglobulin comprising full length heavy and light chains to sclerostin of SEQ ID NO: 1 and/or is cross-blocked from binding to sclerostin of SEQ ID NO: 1 by an immunoglobulin comprising full length heavy and light chains, wherein the immunoglobulin comprising full length heavy and light chains comprise the following CDRs: CDR-H1 of SEQ ID NO: 245, CDR-H2 of SEQ ID NO: 246, CDR-H3 of SEQ ID NO: 247, CDR-L1 of SEQ ID NO: 78, CDR-L2 of SEQ ID NO: 79 and CDR-L3 of SEQ ID NO: 80.

Alternatively, or in addition, the anti-sclerostin antibody cross-blocks the binding of immunoglobulin comprising full length heavy and light chains to sclerostin of SEQ ID NO: 1 and/or is cross-blocked from binding to sclerostin of SEQ ID NO: 1 by an immunoglobulin comprising full length heavy and light chains, wherein the immunoglobulin comprising full length heavy and light chains comprise the following CDRs: CDR-H1 of SEQ ID NO: 269, CDR-H2 of SEQ ID NO: 270, CDR-H3 of SEQ ID NO: 271, CDR-L1 of SEQ ID NO: 239, CDR-L2 of SEQ ID NO: 240 and CDR-L3 of SEQ ID NO: 241.

Examples of suitable anti-sclerostin antibodies and fragments thereof include antibodies and antibody fragments having one or more of CDR-H1, CDR-H2, CDR-H3, CDR-L1, CDR-L2 and CDR-L3 specifically disclosed herein and disclosed in U.S. Patent Publication No. 20070110747. At least one of the regions of CDR-H1, CDR-H2, CDR-H3, CDR-L1, CDR-L2, and CDR-L3 may have at least one amino acid substitution, provided that the antibody retains the binding specificity of the non-substituted CDR. Exemplary the anti-sclerostin antibodies include, but are not limited to, Ab-A, Ab-B, Ab-C, Ab-D, Ab-1, Ab-2, Ab-3, Ab-4, Ab-5, Ab-6, Ab-7, Ab-8, Ab-9, Ab-10, Ab-11, Ab-12, Ab-13, Ab-14, Ab-15, Ab-16, Ab-17, Ab-18, Ab-19, Ab-20, Ab-21, Ab-22, Ab-23, and Ab-24 of U.S. Patent Publication No. 20070110747.

In addition, the anti-sclerostin antibody can comprise at least one CDR sequence having at least 75% identity (e.g., 100% identity) to a CDR selected from SEQ ID NOs: 39, 40, 41, 42, 43, 44, 45, 46, 47, 48, 49, 50, 51, 52, 53, 54, 55, 56, 57, 58, 59, 60, 61, 62, 78, 79, 80, 81, 99, 100, 101, 102, 103, 104, 105, 106, 107, 108, 109, 110, 111, 112, 113, 114, 115, 116, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 351, 352, 353, 358, 359, and 360 provided in the Sequence Listing and disclosed in U.S. Patent Publication No. 20070110747. Preferably, the anti-sclerostin antibody comprises at least one CDR sequence having at least 75% identity to a CDR selected from SEQ ID NOs: 245, 246, 247, 78, 79, 80, 269, 270, 271, 239, 240, and 241, all of which is provided in the Sequence Listing and described in U.S. Patent Publication No. 20070110747. As described in U.S. Patent Publication No. 20070110747, the anti-sclerostin antibody can comprise: a) CDR sequences of SEQ ID NOs:54, 55, and 56 and CDR sequences of SEQ ID NOs:51, 52, and 53; b) CDR sequences of SEQ ID NOs:60, 61, and 62 and CDR sequences of SEQ ID NOs:57, 58, and 59; c) CDR sequences of SEQ ID NOs:48, 49, and 50 and CDR sequences of SEQ ID NOs:45, 46, and 47; d) CDR sequences of SEQ ID NOs:42, 43, and 44 and CDR sequences of SEQ ID NOs:39, 40, and 41; e) CDR sequences of SEQ ID NOs:275, 276, and 277 and CDR sequences of SEQ ID NOs:287, 288, and 289; f) CDR sequences of SEQ ID NOs:278, 279, and 280 and CDR sequences of SEQ ID NOs:290, 291, and 292; g) CDR sequences of SEQ ID NOs:78, 79, and 80 and CDR sequences of SEQ ID NOs: 245, 246, and 247; h) CDR sequences of SEQ ID NOs:81, 99, and 100 and CDR sequences of SEQ ID NOs:248, 249, and 250; i) CDR sequences of SEQ ID NOs:101, 102, and 103 and CDR sequences of SEQ ID NOs:251, 252, and 253; j) CDR sequences of SEQ ID NOs:104, 105, and 106 and CDR sequences of SEQ ID NOs:254, 255, and 256; k) CDR sequences of SEQ ID NOs:107, 108, and 109 and CDR sequences of SEQ ID NOs:257, 258, and 259; l) CDR sequences of SEQ ID NOs:110, 111, and 112 and CDR sequences of SEQ ID NOs:260, 261, and 262; m) CDR sequences of SEQ ID NOs:281, 282, and 283 and CDR sequences of SEQ ID NOs:293, 294, and 295; n) CDR sequences of SEQ ID NOs:113, 114, and 115 and CDR sequences of SEQ ID NOs:263, 264, and 265; o) CDR sequences of SEQ ID NOs:284, 285, and 286 and CDR sequences of SEQ ID NOs:296, 297, and 298; p) CDR sequences of SEQ ID NOs:116, 237, and 238 and CDR sequences of SEQ ID NOs:266, 267, and 268; q) CDR sequences of SEQ ID NOs:239, 240, and 241 and CDR sequences of SEQ ID NOs:269, 270, and 271) CDR sequences of SEQ ID NOs:242, 243, and 244 and CDR sequences of SEQ ID NOs:272, 273, and 274; or s) CDR sequences of SEQ ID NOs:351, 352, and 353 and CDR sequences of SEQ ID NOs:358, 359, and 360.

The anti-sclerostin antibody can comprise at least one CDR sequence having at least 75% identity (e.g., 100% identical) to a CDR selected from CDR-H1, CDR-H2, CDR-H3, CDR-L1, CDR-L2, and CDR-L3 wherein CDR-H1 has the sequence given in SEQ ID NO: 245, CDR-H2 has the sequence given in SEQ ID NO: 246, CDR-H3 has the sequence given in SEQ ID NO: 247, CDR-L1 has the sequence given in SEQ ID NO: 78, CDR-L2 has the sequence given in SEQ ID NO: 79 and CDR-L3 has the sequence given in SEQ ID NO: 80, all of which is provided in the Sequence Listing and described in U.S. Patent Publication No. 20070110747. The anti-sclerostin antibody, in various aspects, comprises two of the CDRs or six of the CDRs. Optionally, the anti-sclerostin antibody comprises all or part of a heavy chain (e.g., two heavy chains) comprising SEQ ID NO: 378 and all or part of a light chain (e.g., two light chains) comprising SEQ ID NO 376.

The anti-sclerostin antibody can comprise at least one CDR sequence having at least 75% identity (e.g., 100% identical) to a CDR selected from CDR-H1, CDR-H2, CDR-H3, CDR-L1, CDR-L2, and CDR-L3 wherein CDR-H1 has the sequence given in SEQ ID NO: 269, CDR-H2 has the sequence given in SEQ ID NO: 270, CDR-H3 has the sequence given in SEQ ID NO: 271, CDR-L1 has the sequence given in SEQ ID NO: 239, CDR-L2 has the sequence given in SEQ ID NO: 240 and CDR-L3 has the sequence given in SEQ ID NO 241, all of which is provided in the Sequence Listing and described in U.S. Patent Publication No. 20070110747. The anti-sclerostin antibody, in various aspects, comprises at least two of the CDRs or six of the CDRs. Optionally, the anti-sclerostin antibody comprises all or part of a heavy chain (e.g., two heavy chains) comprising SEQ ID NO: 366 and all or part of a light chain (e.g., two light chains) comprising SEQ ID NO 364.

Alternatively, the anti-sclerostin antibody can have a heavy chain comprising CDR's H1, H2, and H3 and comprising a polypeptide having the sequence provided in SEQ ID NO: 137, 145, or 392 or a variant thereof in which the CDRs are at least 75% identical (e.g., 100% identical) to SEQ ID NO: 245, 246, and 247, respectively, and a light chain comprising CDR's L1, L2 and L3 and comprising a polypeptide having the sequence provided in SEQ ID NO: 133 or 141 or a variant thereof in which the CDRs are at least 75% identical (e.g., 100% identical) to SEQ ID NO: 78, 79, and 80, respectively (as described in U.S. Patent Publication No. 20070110747).

The anti-sclerostin antibody may have a heavy chain comprising CDR's H1, H2, and H3 and comprising a polypeptide having the sequence provided in SEQ ID NO: 335, 331, 345, or 396 or a variant of any of the foregoing in which the CDRs are at least 75% (e.g., 100% identical) identical to SEQ ID NO: 269, 270, and 271, respectively, and a light chain comprising CDR's L1, L2, and L3 and comprising a polypeptide having the sequence provided in SEQ ID NO: 334 or 341 or a variant of any of the foregoing in which the CDRs are at least 75% identical (e.g., 100% identical) to SEQ ID NO: 239, 240, and 241, respectively (as described in U.S. Patent Publication No. 20070110747). All combinations of the heavy and light chain sequences are contemplated (e.g., heavy chains comprising SEQ ID NO: 335 and light chains comprising SEQ ID NO: 334; heavy chains comprising SEQ ID NO: 331 and light chains comprising SEQ ID NO: 334 or 341; and heavy chains comprising SEQ ID NO: 345 or 396 and light chains comprising SEQ ID NO: 341).

Alternatively, the anti-sclerostin antibody has a heavy chain comprising a polypeptide having the sequence provided in SEQ ID NO:137, and a light chain comprising a polypeptide having the sequence provided in SEQ ID NO:133; a heavy chain comprising a polypeptide having the sequence provided in SEQ ID NO:145 or 392, and a light chain comprising a polypeptide having the sequence provided in SEQ ID NO: 141; a heavy chain comprising a polypeptide having the sequence provided in SEQ ID NO:335, and a light chain comprising a polypeptide having the sequence provided in SEQ ID NO:334; a heavy chain comprising a polypeptide having the sequence provided in SEQ ID NO:331, and a light chain comprising a polypeptide having the sequence provided in SEQ ID NO:341; or a heavy chain comprising a polypeptide having the sequence provided in SEQ ID NO:345 or 396, and a light chain comprising a polypeptide having the sequence provided in SEQ ID NO:341 (as described in U.S. Patent Publication No. 20070110747).

Examples of anti-sclerostin antibodies also include, but are not limited to, the anti-sclerostin antibodies disclosed in International Patent Publication Nos. WO 2008/092894, WO 2008/115732, WO 2009/056634, WO 2009/047356, WO 2010/100200, WO 2010/100179, WO 2010/115932, and WO 2010/130830 (each of which is incorporated by reference herein in its entirety), such as an anti-sclerostin antibody comprising CDRs of SEQ ID NOs: 20-25 of International Patent Publication No. WO 2008/115732 (SEQ ID NOs: 416-421 herein), an anti-sclerostin antibody comprising CDRs of SEQ ID NOs: 26-31 of International Patent Publication No. WO 2008/115732 (SEQ ID NOs: 422-427 herein), an anti-sclerostin antibody comprising CDRs of SEQ ID NOs: 32-37 of International Patent Publication No. WO 2008/115732 (SEQ ID NOs: 428-433 herein), an anti-sclerostin antibody comprising CDRs of SEQ ID NOs: 4, 15, 26, 37, 48, and 59 of International Patent Publication No. WO 2009/047356 (SEQ ID NOs: 443, 454, 465, 476, 487 and 498, respectively, herein), or an anti-sclerostin antibody comprising the amino acid sequence of at least one of SEQ ID NOs: 135-143, 153-161, or 171-179 of International Patent Publication No. WO 2010/130830 (SEQ ID NOs: 745-753, 763-771, 781-789, respectively, herein).

Alternatively, the methods described herein comprise administering a sclerostin inhibitor other than an anti-sclerostin antibody. Such agents can act directly or indirectly on SOST or sclerostin. Sclerostin inhibitors contemplated for use in the methods described herein include those described in U.S. Patent Publication No. 2003/0229041 (the entire disclosure of which is hereby incorporated by reference, with particular emphasis upon the description of sclerostin inhibitors). For example, agents useful for modulating SOST expression and sclerostin activity include, but are not limited to, steroids (such as those corresponding to Formula 1 of U.S. Patent Publication No. 2003/0229041), alkaloids, terpenoids, peptoids, and synthetic chemicals. In some embodiments, the SOST antagonist or agonist can bind to a glucocorticoid receptor. For example, dexamethasone tends to abolish the stimulatory effect of BMP-4 and BMP-6 on SOST expression. Other chemical entities including glucocorticoid analogs, bile salts (such as those corresponding to Formula 3 of U.S. Patent Publication No. 2003/0229041), and prostaglandins (such as those corresponding to Formula 2 of U.S. Patent Publication No. 2003/0229041) also modulate the effects of bone morphogenetic proteins on SOST expression, and are contemplated for use in the methods described herein.

Sclerostin expression inhibitors that may be used according to the methods described herein include, but are not limited to, inhibitory nucleic acids, including pharmaceutically acceptable salts thereof, e.g., sodium salts. In some embodiments, the inhibitory nucleic acid as described elsewhere herein is selected from the group consisting of antisense oligonucleotides, ribozymes, external guide sequence (EGS) oligonucleotides, siRNA compounds, single- or double-stranded RNA interference (RNAi) compounds such as siRNA compounds, modified bases/locked nucleic acids (LNAs), antagomirs, peptide nucleic acids (PNAs), and other oligomeric compounds or oligonucleotide mimetics which hybridize to at least a portion of the target nucleic acid and modulate its function. In some embodiments, the inhibitor nucleic acid is single stranded or double stranded. In some embodiments, the inhibitory nucleic acid is an antisense oligonucleotide, modified bases/locked nucleic acids (LNA), peptide nucleic acids (PNA), arabinonucleic acids (ANA) (as described, for example, in PCT Publication No. WO 99/67378); 2'-fluoro-D-Arabinonucleic acids (FANA) (as described in, for example, Lon et al., *Biochem.*, 41:3457-3467, 2002 and Min et al., *Bioorg. Med. Chem. Lett.*, 12:2651-2654, 2002; the disclosures of which are incorporated herein by reference in their entireties); phosphorodiamidate morpholino oligomers (PMO) (e.g., as described in Iverson, *Curr. Opin. Mol. Ther.*, 3:235-238, 2001; and Wang et al., *J. Gene Med.*, 12:354-364, 2010; the disclosures of which are incorporated herein by reference in their entireties); ethylene bridged nucleic acids (as described in, for example, International Patent Publication No. WO 2005/042777, Morita et al., *Nucleic Acid Res.*, Suppl 1:241-242, 2001; Surono et al., *Hum. Gene Ther.*, 15:749-757, 2004; Koizumi, *Curr. Opin. Mol. Ther.*, 8:144-149, 2006 and Horie et al., *Nucleic Acids Symp. Ser (Oxf)*, 49:171-172, 2005; the disclosures of which are incorporated herein by reference in their entireties); 2'-0,4'-C-ethylene-bridged nucleic acid, ribozyme, external guide sequence (EGS) oligonucleotides, microRNAs (miRNAs), small, temporal RNAs (stRNAs), and single- or double-stranded RNA interference (RNAi) compounds or siRNA. In some embodiments, the inhibitory nucleic acid comprises at least one nucleotide and/or nucleoside modification (e.g., oligonucleotides with modified backbones or modified sugar moieties).

Activity of a particular sclerostin inhibitor, e.g., anti-sclerostin antibody or antibody fragment, for use in the methods described herein may be measured in a variety of ways, including the methods described above for detecting increases in bone mineral content or bone density. The ability of a sclerostin inhibitor to modulate bone mass may be calculated from body weights or by using other methods (see Guinness-Hey, *Metab. Bone Dis. Relat. Res.*, 5:177-181 (1984)). Animals and particular animal models are used in the art for testing the effect of the pharmaceutical compositions and methods on, for example, parameters of bone loss, bone resorption, bone formation, bone strength, or bone mineralization. Examples of such models include the ovariectomized rat model (Kalu, *Bone and Mineral*, 15:175-192 (1991); Frost and Jee, *Bone and Mineral*, 18:227-236 (1992); and Jee and Yao, *J. Musculoskel. Neuron. Interact.*, 1:193-207 (2001)). The methods for measuring sclerostin binding agent activity described herein also may be used to determine the efficacy of other sclerostin inhibitors.

Alternatively, a sclerostin inhibitor can be selected based on its ability to modulate bone marker levels. Bone markers are products created during the bone remodeling process and are released by bone, osteoblasts, and/or osteoclasts. Fluctuations in bone resorption and/or bone formation "marker" levels imply changes in bone remodeling/modeling. The International Osteoporosis Foundation (IOF) recommends using bone markers to monitor bone density therapies (see, e.g., Delmas et al., *Osteoporos Int.*, Suppl. 6:S2-17 (2000), incorporated herein by reference). Markers indicative of bone resorption (or osteoclast activity) include, for example, C-telopeptide (e.g., C-terminal telopeptide of type 1 collagen (CTX) or serum cross-linked C-telopeptide), N-telopeptide (N-terminal telopeptide of type 1 collagen (NTX)), deoxypyridinoline (DPD), pyridinoline, urinary hydroxyproline, galactosyl hydroxylysine, and tartrate-resistant acid phosphatase (e.g., serum tartrate-resistant acid phosphatase isoform 5b). Bone formation/mineralization markers include, but are not limited to, bone-specific alkaline phosphatase (BSAP), peptides released from N- and C-terminal extension of type I procollagen (P1NP, PICP), and osteocalcin (OstCa). Several kits are commercially-available to detect and quantify markers in clinical samples, such as urine and blood.

Routes of Administration

The sclerostin inhibitor is preferably administered to a subject in a physiologically-acceptable (e.g., pharmaceutical) composition, which can include carriers, excipients, or diluents. It will be appreciated that the sclerostin inhibitors (e.g., an anti-sclerostin antibody or antibody fragment) described herein may be used in the preparation of a medicament for administration using any of the dosage and timing regimens disclosed herein. Pharmaceutical compositions and methods of treatment are disclosed in U.S. Patent Publication No. 20050106683 and 2007/110747, which are incorporated by reference herein. "Physiologically-acceptable" refers to molecular entities and compositions that do not produce an allergic or similar untoward reaction when administered to a human. In addition, the composition administered to a subject may contain more than one sclerostin inhibitor (e.g., two anti-sclerostin antibodies, or a sclerostin binding agent and a synthetic chemical sclerostin inhibitor) or a sclerostin inhibitor in combination with one or more therapeutics having different mechanisms of action.

The development of compositions suitable for use in a variety of routes of administration, including e.g., subcutaneous, oral, parenteral, intravenous, intranasal, and intramuscular administration and formulation, is well known in the art and discussed in U.S. Patent Publication No. 2007/0110747. For example, in certain circumstances, it will be desirable to deliver a pharmaceutical composition comprising a sclerostin binding agent subcutaneously, parenterally, intravenously, intramuscularly, or even intraperitoneally. Such approaches are well known to the skilled artisan, some of which are further described, for example, in U.S. Pat. Nos. 5,543,158; 5,641,515; and 5,399,363. Illustrative pharmaceutical forms suitable for injectable use include sterile aqueous solutions or dispersions and sterile powders for the extemporaneous preparation of sterile injectable solutions or dispersions (for example, see U.S. Pat. No. 5,466,468). In all cases the form must be sterile and must be fluid to the extent that easy syringability exists (i.e., is not excessively viscous so as to prevent passage through a syringe).

In one aspect, the sclerostin inhibitor (e.g., anti-sclerostin antibody or antibody fragment) is administered systemically. In one embodiment, for parenteral administration in an aqueous solution, the solution should be suitably buffered if necessary and the liquid diluent first rendered isotonic with sufficient saline or glucose. These particular aqueous solutions are especially suitable for intravenous, intramuscular, subcutaneous, and intraperitoneal administration. For example, one dosage may be dissolved in 1 ml of isotonic NaCl solution and either added to 1000 ml of hypodermoclysis fluid or injected at the proposed site of infusion (see, for example, Remington's Pharmaceutical Sciences, 15th ed., Mack Pub. Co., Easton, Pa., pp. 1035-1038 and 1570-1580). Some variation in dosage and frequency of administration may occur depending on the condition of the subject being treated; age, height, weight, and overall health of the patient; and the existence of any side effects. In addition, a pharmaceutical composition comprising a sclerostin binding agent may be placed within containers (e.g. vials or pre-filled syringes), along with packaging material that provides instructions regarding the use of such pharmaceutical compositions. Generally, such instructions will include a tangible expression describing the reagent concentration, as well as within certain embodiments, relative amounts of excipient ingredients or diluents (e.g., water, saline or PBS) that may be necessary to reconstitute the pharmaceutical composition.

In another aspect, the sclerostin inhibitor is administered locally to the subject. In some or any embodiments, the sclerostin inhibitor (e.g., anti-sclerostin antibody or antibody fragment) is administered by disease to the diseased gingival, bone or tooth area. In this regard, the sclerostin inhibitor (e.g., anti-sclerostin antibody or antibody fragment) is optionally injected directly into the gingival tissue and/or applied to the periodontal pocket by, for example, a syringe containing the sclerostin inhibitor and an appropriate carrier.

For local administration aspects (such as subcutaneous injection of the sclerostin inhibitor directly into the diseased gingival area or diseased periodontal pocket of the subject), the sclerostin inhibitor is optionally administered to a subject in an amount of about 0.1 mg to about 20 mg. In some embodiments, the sclerostin inhibitor is administered directly to the affected area in an amount of about 0.1 mg, 0.5 mg, 1 mg, 2 mg, 3 mg, 4 mg, 5 mg, 6 mg, 7 mg, 8 mg, 9 mg, 10 mg, 11 mg, 12 mg, 13 mg, 14 mg, 15 mg, 16 mg, 17 mg, 18 mg, 19, or about 20 mg. The dose is administered at any interval, such as multiple times a week (e.g., twice or three times per week), once a week, once every two weeks, once every three weeks, or once every four weeks. In some or any embodiments, a dose of sclerostin inhibitor (e.g., anti-sclerostin antibody or antibody fragment) ranging from about 0.1 mg to about 20 mg is administered twice a week. The amount of inhibitor is optionally administered as a divided dose, e.g., using multiple injections along a segment of the affected area.

In some or any embodiments, the sclerostin inhibitor (e.g., anti-sclerostin antibody or antibody fragment) is incorporated into a gel, mesh, matrix or collagen sponge, embedded in a dental implant or bone graft, or coated on an implant. The implant may be a re-implantation of a subject's own tooth (e.g., lost through trauma) or a prosthetic implant (made of, for example, plastic, ceramic, metal or from stem cells as described in WO 2004/074464).

The term "mesh" means any material in any form including, for example, knotted, braided, extruded, stamped, knitted, woven, non-woven or other form, and may include a material with a substantially regular and/or irregular patterns. Examples of non-woven meshes, including electrospun materials, may be used (for a review on the preparation electrospun nanofiber material see Zheng-Ming Huang et al, Composites Science and Technology, 2003, 63:2223-2253). A mesh can be, without limitation, a cross-linked fiber mesh, a nanofiber mesh, a mesh fabric, biodegradable polymer mesh, or a combination of any of the foregoing. A mesh can be non-degradable, degradable or biodegradable. A degradable mesh can be a mesh that can be degraded via non-biological means (e.g., hydrolysis or photolysis). A biodegradable mesh is, in various embodiments, a type of mesh that can be broken down by a biological system through the action of cells or digestive enzymes or via oxidation by biomolecules.

Exemplary gel formulations for oral delivery of antibodies is described in WO 2010/1004179, the disclosure of which is incorporated herein by reference. In some embodiments, the gel is a hydrogel made of high molecular weight biocompatible elastomeric polymers of synthetic or natural origin. A desirable property for hydrogels is the ability to respond rapidly to mechanical stresses, particularly shears and loads, in the human body. Hydrogels obtained from natural sources are contemplated because they are more likely to be biodegradable and biocompatible for in vivo applications. Suitable hydrogels include natural hydrogels, such as, for example, gelatin; collagen; silk; elastin; fibrin and polysaccharide-derived polymers; glucomannan gel; hyaluronic acid; polysaccharides, such as cross-linked carboxyl-containing polysaccharides, or a combination thereof. Synthetic hydrogels include, but are not limited to, those formed from polyvinyl alcohol; acrylamides such as polyacrylic acid and poly(acrylonitrile-acrylic acid); polyurethanes; polyethylene glycol (e.g., PEG 3350, PEG 4500, PEG 8000); silicone; polyolefins such as polyisobutylene and polyisoprene; copolymers of silicone and polyurethane; neoprene; nitrile; vulcanized rubber; poly(N-vinyl-2-pyrrolidone); acrylates such as poly(2-hydroxy ethyl methacrylate) and copolymers of acrylates with N-vinyl pyrolidone; N-vinyl lactams; polyacrylonitrile or combinations thereof. The hydrogel materials may further be cross-linked to provide further strength as needed. Examples of different types of polyurethanes include thermoplastic or thermoset polyurethanes, aliphatic or aromatic polyurethanes, polyetherurethane, polycarbonate-urethane or silicone polyether-urethane, or a combination thereof.

In various embodiments, rather than directly admixing the sclerostin inhibitor into the gel, microspheres being loaded with the sclerostin inhibitor may be dispersed within the gel. In one embodiment, the microspheres provide for a sustained release of the sclerostin inhibitor. In yet another embodiment, the gel, which is biodegradable, prevents the microspheres from releasing the sclerostin inhibitor; the microspheres thus do not release the sclerostin inhibitor until they have been released from the gel. For example, a gel may be deployed around a target tissue site (e.g., alveolar ridge).

The invention also contemplates the use of adherent gels to constrain dispersal of the sclerostin inhibitor. The gels may be deployed, for example, in the periodontal pocket, tooth, alveolar bone or in surrounding gingival tissue.

In some or any embodiments, the sclerostin inhibitor is formulated into pastes, balms, waxes, lotions, rinsing solutions, dried powers with/without bulking agent and various other formats for topical administration known in the art. The sclerostin inhibitor may also be delivered locally in the form of a powder or solution sprayed, or gargling solutions. Alternatively, the sclerostin inhibitor is incorporated into wound dressings, pads, gauze, or other means applied to the diseased area of interest (e.g., diseased gingival area or periodontal pocket) from which they are transferred to the area of interest.

Combination Therapy

Treatment of a pathology by combining two or more agents that target the same pathogen or biochemical pathway sometimes results in greater efficacy and diminished side effects relative to the use of the therapeutically relevant dose of each agent alone. In some cases, the efficacy of the drug combination is additive (the efficacy of the combination is approximately equal to the sum of the effects of each drug alone), but in other cases the effect can be synergistic (the efficacy of the combination is greater than the sum of the effects of each drug given alone). As used herein, the term "combination therapy" means the two compounds can be delivered in a simultaneous manner, e.g., concurrently, or wherein one of the compounds is administered first, followed by the second agent, e.g., sequentially. The desired result can be either a subjective relief of one or more symptoms or an objectively identifiable improvement in the recipient of the dosage.

In some embodiments, the sclerostin inhibitor (e.g. anti-sclerostin antibody or antibody fragment) is administered in combination with the use of materials that support the regrowth of bone such as bone graft, bone dust, bone chips, demineralized bone matrix, bone scaffolds, prosthesis, metal stabilizers, or bone scaffold substances comprising one or more of polymers, ceramics, cement and calcium phosphates-based bone-graft substitutes. Many variations of such materials are known in the art.

In some or any embodiments, a method or use described herein comprises administering a standard of care therapy for the treatment of the periodontal disease to the subject prior to administering the sclerostin inhibitor (e.g., anti-sclerostin antibody or antibody fragment). For example, in some embodiments, the standard of care therapy for the treatment of periodontal disease is a therapeutic selected from the group consisting of Periostat® and chemically modified tetracycline-3 (CMT-3). In some embodiments, the standard of care therapy comprises oral irrigation and/or scaling and supra- and/or sub-gingival debridement (e.g., removal of microbial plaque and calculus) of the affected area of the subject. In some embodiments, the standard of care comprises performing oral irrigation and/or scaling and debridement of the affected area in combination with Periostat and/or CMT-3 prior to administration of the sclerostin inhibitor. In some embodiments, the method comprises administering the standard of care therapy concurrently with the administration of the sclerostin inhibitor. In other embodiments, the standard of care therapy is administered sequentially. For example, the standard of care therapy can be administered 1 day, 2 days, 3 days, 4 days, 5 days, 6 days, 1 week, 2 weeks, 3 weeks, 4 weeks, 6 weeks, 8 weeks, 10 weeks, 12 weeks or more prior to administering the sclerostin inhibitor to the subject. In preferred embodiments, the periodontal disease progression in the subject is slowed, halted or reversed prior to administration of the sclerostin inhibitor.

In some or any embodiments, a method or use described herein further comprises administering an antibiotic, such as an antibiotic selected from the group consisting of amoxicillin, tetracycline hydrochloride, doxycycline, minocycline, azithromycin, roxithromycin, moxifloxacin, ciprofloxacin and metronidazole. In some embodiments, the method or use comprises administering the antibiotic to the subject prior to administering the sclerostin inhibitor to the subject. In other embodiments, the method or use comprises administering the antibiotic to the subject concurrently with the administration of the sclerostin inhibitor.

In some embodiments, the sclerostin inhibitor (e.g., anti-sclerostin antibody or antibody fragment) is administered along with a second bone-enhancing therapeutic useful for the treatment of decreased bone mineral density or bone defect. In some embodiments, the bone-enhancing therapeutic is selected from the group consisting of an anti-resorptive drug, a bone-forming agent, an estrogen receptor modulator (including, but not limited to, raloxifene, bazedoxifene and lasofoxifene) and a drug that has an inhibitory effect on osteoclasts. In some embodiments, the second bone-enhancing agent is selected from the group consisting of a bisphosphonate (including, but not limited to, alendronate sodium (FOSAMAX®), risedronate, ibandronate sodium (BONIVA®) and zoledronic acid (RECLAST®)); an estrogen or estrogen analogue; an anti-RANK ligand (RANKL)

antibody (e.g., PROLIA®) or RANKL inhibitor; vitamin D, or a vitamin D derivative or mimic thereof; a calcium source, Tibolone, calcitonin, a calcitriol; and hormone replacement therapy. In some embodiments, the second bone-enhancing agent includes, but is not limited to parathyroid hormone (PTH) or a peptide fragment thereof, PTH-related protein (PTHrp), bone morphogenetic protein, osteogenin, NaF, a $PGE_2$ agonist, a statin, strontium ranelate, an anti-DKK1 antibody or inhibitor. In some embodiments, the second bone-enhancing agent is Forteo® (Teriparatide), Preotact®, or Protelos®.

In various embodiments, the periodontal disease treatment plan includes regular supportive follow-up therapy after active treatment with the sclerostin inhibitor is completed. In some embodiments, the method or uses described herein optionally comprise performing a supportive follow-up therapy selected from the group consisting of mechanical debridement, reinforcement of oral hygiene (e.g., regular profession cleanings (i.e., every 6 months), daily brushing and flossing) and administration of antibiotics.

In some embodiments, the combination therapy employing a sclerostin inhibitor described herein may precede or follow administration of additional therapeutic(s) (e.g., an antibiotic or second bone-enhancing agent) by intervals ranging from minutes to weeks. For example, separate modalities are administered within about 24 hours of each other, e.g., within about 6-12 hours of each other, or within about 1-2 hours of each other, or within about 10-30 minutes of each other. In some situations, it may be desirable to extend the time period for treatment significantly, where several days (2, 3, 4, 5, 6 or 7 days) to several weeks (1, 2, 3, 4, 5, 6, 7 or 8 weeks) lapse between the respective administrations of different modalities. Repeated treatments with one or both agents/therapies of the combination therapy is specifically contemplated.

Maintenance Therapeutic Regimen

Also contemplated is the use of a second bone-enhancing agent and/or sclerostin inhibitor in a maintenance regimen to, e.g., prevent or slow the loss of one or more of the following parameters of alveolar bone: bone mineral density, alveolar bone height, alveolar bone mass, alveolar bone volume and alveolar bone mineral content. In this regard, a method or use described herein optionally comprises administering one or more amounts of a second bone-enhancing agent effective to maintain bone mineral density, alveolar bone height, alveolar bone mass, alveolar bone volume and alveolar bone mineral content for a maintenance period of about 1 week to about 5 years after the treatment period with the sclerostin antibody has ended. For example, in some embodiments, a method or use described herein comprises the administration of a second bone-enhancing agent to the subject for a maintenance period of about at least about 1 week, 2 weeks, 3 weeks, 4 weeks, 5 weeks, 6 weeks, 7 weeks, 8 weeks, 9 weeks, 10 weeks, 11 weeks, 12 weeks, 3 months, 13 weeks, 14 weeks, 15 weeks, 16 weeks, 4 months, 17 weeks, 18 weeks, 19 weeks, 20 weeks, 5 months, 21 weeks, 22 weeks, 23 weeks, 24 weeks, 6 months, 25 weeks, 26 weeks, 27 weeks 28 weeks, 7 months, 29 weeks, 30 weeks, 31 weeks or longer (e.g., 8 months, 9 months, 10 months, 11 months, 1 year, 15 months, 18 months, 2 years, 3 years, 4 years, 5 years or longer (e.g., over the lifetime of the subject). In some embodiments, the maintenance period is about 6-12 weeks. In some embodiments, the maintenance period is about 4-12 weeks, or about 1-3 months. In some embodiments, the maintenance period is about 12-20 weeks, or about 3-5 months. In some embodiments, the maintenance period is about 20-32 weeks, or about 5-8 months. In some embodiments, the maintenance period is about 24-36 weeks, or about 6-9 months. In some embodiments, the maintenance period is about 1 year, about 2 years, about 3 years, about 4 years, about 5 years or longer. "Maintaining" alveolar bone includes maintaining similar levels of alveolar bone parameters experienced in the subject that received the sclerostin inhibitor treatment.

Similarly, a method or use described herein optionally comprises subsequently administering one or more amounts of a sclerostin inhibitor effective to bone mineral density, alveolar bone height, alveolar bone mass, alveolar bone volume and alveolar bone mineral content for a maintenance period of at least about least about 1 week, 2 weeks, 3 weeks, 4 weeks, 5 weeks, 6 weeks, 7 weeks, 8 weeks, 9 weeks, 10 weeks, 11 weeks, 12 weeks, 3 months, 13 weeks, 14 weeks, 15 weeks, 16 weeks, 4 months, 17 weeks, 18 weeks, 19 weeks, 20 weeks, 5 months, 21 weeks, 22 weeks, 23 weeks, 24 weeks, 6 months, 1 year, 2 years, 3 years, 4 years, 5 years or longer (e.g., over the lifetime of the subject) after the treatment period has ended. In some embodiments, the maintenance period is about 6-12 weeks. In some embodiments, the maintenance period is about 4-12 weeks, or about 1-3 months. In some embodiments, the maintenance period is about 12-20 weeks, or about 3-5 months. In some embodiments, the maintenance period is about 20-32 weeks, or about 5-8 months. In some embodiments, the maintenance period is about 24-36 weeks, or about 6-9 months. In some embodiments, the maintenance period is about 1 year, about 2 year, about 3 years, about 4 years, about 5 years or longer.

Kits

A pharmaceutical composition comprising the sclerostin inhibitor (e.g., anti-sclerostin antibody or antibody fragment) may be placed within containers (e.g., vials or syringes), along with packaging material that provides instructions regarding the use of such pharmaceutical compositions. Generally, such instructions will include a tangible expression describing the sclerostin inhibitor concentration, as well as within certain embodiments, relative amounts of excipient ingredients or diluents (e.g., water, saline or PBS) that may be necessary to reconstitute the pharmaceutical composition.

The invention is further described in the following examples. The following examples serve only to illustrate the invention and are not intended to limit the scope of the invention in any way.

EXAMPLES

Example 1

This Example describes various cell-based neutralization assays useful for characterizing the neutralization activity of an anti-sclerostin antibody.

MC3T3 Cell-Based Mineralization Assay

Ascorbic acid and B-glycerophosphate are used to induce MC3T3-E1-BF cell differentiation leading to mineral deposition. An exemplary screening protocol, in 96-well format, involves plating cells on day 1, followed by seven media changes over a 12-day period with most of the mineral deposition taking place in the final eighteen hours. The specific timing, and extent, of mineral deposition may vary depending, in part, on the particular serum lot number being used. Control experiments will allow such variables to be accounted for, as is well known in the art of cell culture experimentation generally. For statistical analysis (using MS Excel and JMP) a 1-way-ANOVA followed by Dunnett's comparison may be used to determine differences between groups. Group means for each data set are considered significantly different when the P value is less than 0.05 (P<0.05).

Cell culture for expansion of MC3T3-E1-BF cells is performed as follows. Cell culture is performed at 37° C. and 5% $CO_2$. A cell bank can be generated for the purposes of screening for sclerostin neutralizing antibodies. One vial of frozen MC3T3-E1-BF cells are thawed by agitation in a 37° C. water bath. The thawed cells are put into 10 mls of Expansion Medium (Alpha-MEM/10% FBS/PenStrepGlu) in a 50 ml tube and gently spun down for 5 minutes. The cells are then resuspended in 4 mls of Alpha-MEM/10% FBS/PenStrepGlu. After determining the number of cells using trypan blue and hemacytometer, $1 \times 10^6$ cells are plated in 50 mls Alpha-MEM/10% FBS/PenStrepGlu media in one T175 flask.

When this passage is confluent (at approximately 7 days), the cells are trypsinized with trypsin/EDTA (0.05% Trypsin; 0.53 mM EDTA), gently spun down for 5 minutes and then resuspended in 5 mls Alpha-MEM/10% FBS/PenStrepGlu. After determining the number of cells using trypan blue and hemacytometer, cells are plated at $1 \times 10^6$ cells in 50 mls Alpha-MEM/10% FBS/PenStrepGlu media per one T175 flask. The number of T175 flasks used for plating at this point depends upon the total cell number available and the desired number of flasks that are to be taken forward to the next passage.

When this passage is confluent (about 3-4 days), the cells are trypsinized with trypsin/EDTA (0.05% Trypsin; 0.53 mM EDTA), gently spun down for 5 minutes and then resuspended in 5 mls Alpha-MEM/10% FBS/PenStrepGlu. After determining the number of cells using trypan blue and hemacytometer, cells are plated at $1 \times 10^6$ cells in 50 mls Alpha-MEM/10% FBS/PenStrepGlu media per one T175 flask. The number of T175 flasks used for plating at this point depends upon the total cell number available and the desired number of flasks that were to be taken forward to the next passage.

When this passage is confluent (about 3-4 days), the cells are trypsinized with trypsin/EDTA (0.05% Trypsin; 0.53 mM EDTA), gently spun down for 5 minutes and then resuspended in 5 mls Alpha-MEM/10% FBS/PenStrepGlu. After determining the number of cells using trypan blue and hemacytometer, cells are plated at $1 \times 10^6$ cells in 50 mls Alpha-MEM/10% FBS/PenStrepGlu media per one T175 flask. The number of T175 flasks used for plating at this point depends upon the total cell number available and the desired number of flasks that were to be taken forward to the next passage. Extra cells are frozen down at $1-2 \times 10^6$ live cells/ml in 90% FBS/10% DMSO.

When this passage is confluent (about 3-4 days), the cells were trypsinized with trypsin/EDTA (0.05% Trypsin; 0.53 mM EDTA), gently spun down for 5 minutes and then resuspended in 5 mls Alpha-MEM/10% FBS/PenStrepGlu. After determining the number of cells using trypan blue and hemacytometer, the cells are frozen down at $1-2 \times 10^6$ live cells/ml in 90% FBS/10% DMSO. This "final passage" of frozen cells is the passage used for the screening assay.

Cell culture for mineralizing MC3T3-E1-BF cells is performed as follows. Cell culture is performed at 37° C. and 5% $CO_2$. It is desirable to minimize temperature and % $CO_2$ fluctuations during the mineralization cell culture procedure. An appropriate number of "final passage" vials prepared as described above are thawed by agitation in a 37° C. water bath. The thawed cells are put into 10 mls of Expansion Medium (Alpha-MEM/10% FBS/PenStrepGlu) in a 50 ml tube and gently spun down for 5 minutes. The cells are then resuspended in 4 mls of Alpha-MEM/10% FBS/PenStrep-Glu. After determining the number of cells by trypan blue and hemacytometer, 2500 cells are plated in 200 microliters of Expansion media per well on collagen I coated 96-well plates (Becton Dickinson Labware, cat #354407).

An exemplary cell culture procedure is as follows. The starting day for plating the cells is indicated to be a Wednesday. If a different day of the week is used as the starting day for plating the cells, that day will trigger the daily schedule for removing and adding media during the entire process as indicated below. For example, if the cells are plated on a Tuesday, media should not be removed and added on the first Friday and Saturday, nor on the second Friday and Saturday. With a Tuesday start, the plates would be prepared for the calcium assay on the final Sunday. Cells are plated on a Wednesday at 2500 cells in 200 µl of Expansion media. On Thursday all of the Expansion media is removed and 200 µl of Differentiation Media is added. On Friday 100 µl of media is removed and 100 µl of fresh Differentiation Media is added. On Monday 100 µl of media is removed and 100 µl of fresh Differentiation Media is added. On Tuesday 100 µl of media is removed and 100 µl of fresh Differentiation Media is added. On Wednesday 100 µl of media is removed and 100 µl of fresh Differentiation Media is added. On Thursday 100 µl of media is removed and 100 µl of fresh Differentiation Media is added. On Friday 100 µl of media is removed and 100 µl of fresh Differentiation Media is added. On the following Monday plates are prepared for the calcium assay as follows: Plates are washed once with 10 mM Tris, HCl pH 7-8. Working under a fume hood, 200 µl of 0.5 N HCl is added per well. Plates are then frozen at −80° C. Just prior to measuring calcium, the plates are freeze-thawed twice, and then trituration with a multichannel pipette is used to disperse the contents of the plate. The contents of the plate is then allowed to settle at 4° C. for 30 minutes at which point an appropriate amount of supernatant is removed for measuring calcium using a commercially available calcium kit. An exemplary and not-limiting kit is Calcium (CPC) Liquicolor, Cat. No. 0150-250, Stanbio Laboratory, Boerne, Tex.

In this cell based assay, sclerostin inhibits one or more of the sequence of events leading up to and including mineral deposition (i.e. sclerostin inhibits mineralization). Thus, in experiments where sclerostin is included in the particular cell culture experiment, the recombinant sclerostin is added to the media starting on the first Thursday and every feeding day thereafter. In cases where an anti-sclerostin antibody is being tested for the ability to neutralize sclerostin, i.e., allow for mineralization by neutralizing sclerostin's ability to inhibit mineralization, the antibody is added to the media starting on the first Thursday and every feeding day thereafter. The antibody is preincubated with the recombinant sclerostin in Differentiation media for 45-60 minutes at 37° C. and then this media is used for feeding the cells.

Described above is a 12-day mineralization protocol for MC3T3-E1-BF cells. Mineralization of the original MC3T3-E1 cells is inhibited by recombinant sclerostin and this inhibition is blocked using an anti-sclerostin neutralizing antibody, e.g., an anti-sclerostin antibody comprising CDRs of SEQ ID NO: 245-247 and 78-80. The cell-based neutralization assay is further described in U.S. Pat. Publication No. 7,592,429 at, e.g., Example 8 (hereby incorporated by reference for its description of cell-based neutralization assays).

Bone Specific Alkaline Phosphatase Assay

An exemplary bone specific alkaline phosphatase assay is described in International Patent Publication No. WO 2008/

115732 and U.S. Pat. No. 7,744,874 (hereby incorporated by reference for its description of cell-based neutralization assays). An exemplary protocol is as follows. C2C12 cells (ATCC, CRL 1772) are plated at 3000-5000 cells/well in a 96-well tissue culture plate in MEM medium supplemented with 5% fetal calf serum. The plate is incubated at 37° C. in 5% $CO_2$ overnight. The antibody is diluted in 0.5× Wnt3a-conditioned medium (prepared as described in WO 2008/115732) to various final concentrations. The medium is removed from the plated cells and a pre-mixed antibody-BMP4-sclerostin solution (human or cynomologous monkey) is added (150 μl, providing an antibody final concentration of 30 μg/ml to 0.5 μg/ml, a final BMP-4 concentration of 25 ng/ml, a final sclerostin protein concentration of 1.0 μg/ml, and the conditioned medium is at 0.5× concentration. The plate is then incubated at 37° C. in 5% $CO_2$ for 72 hours. The medium is removed from the cells, which are washed once with PBS, and frozen and thawed three times alternating between −80° C. and 37° C. Alkaline phosphatase activity is measured by adding alkaline phosphatase substrate (1-step PNPP, Pierce #37621) (150 μl/well). The plate of cells is incubated for 60 minutes at room temperature, at which time optical density (OD) is measured at 405 nm to determine alkaline phosphatase activity. $IC_{50}$ calculations may be performed using, e.g., SigmaPlot Regression Wizard with a Sigmoid 4-parameter fit equation.

BMP2-Induced MC3T3 Cell Mineralization Assay

An exemplary BMP2-induced mineralization assay in MC3T3 cells is described in International Patent Publication No. WO 2009/047356 (hereby incorporated by reference for its description of cell-based neutralization assays). Briefly, MC3T31b cells are seeded in 96-well plates (e.g., $6\times10^3$ cells/well or $2\times10^3$ cells/well) in 100 μl assay culture medium (maintenance culture medium without G418) and incubated for three days to reach confluence. The assay culture medium is changed and compounds to be tested are added with 10 mM b-glycerophosphate and 50 μM ascorbic acid. Prior to addition to the cells, sclerostin and a candidate antibody are pre-incubated on a separate plate for two hours at room temperature. To the assay 96 well-plates, 2.1 or 2.8 nM BMP-2 (R&D Systems, Cat#355-BM-010) is applied before applying the sclerostin-antibody mixture. Cells are incubated for 14 days. At the end of the incubation, cells are washed twice with 200 μl PBS/well, 50 μl of 0.5 M HCl is added to each well, and plates are frozen at −20° C. for a minimum of 24 hours. Plates are thawed at room temperature for 2 hours for testing. Ten 10 μl of each well is transferred to a new plate and exposed to Calcium Working Solution (1:5) (200 μl). Optical density is measured after a 5-30 minute incubation period at 595 nm on a microplate reader. Absorbance is translated into microgram of calcium according to a standard curve, allowing determination of the extent of BMP-2-induced mineralization.

Cell-Based wnt Signaling Assay

An exemplary cell-based signaling assay employing super top flash (STF) reporter protein is described in International Patent Publication No. WO 2009/047356. HEK293 cells are transfected with pcDNA3+ (480 ng); SuperTopFlash (STF) (20 ng); and phRL-CMV (0.5 ng) for control wells and pcDNA-wnt1 (20 ng); pcDNA3+(460 ng); SuperTopFlash (STF) (20 ng); and phRL-CMV (0.5 ng) for Wnt1 treatment wells. The plasmids are mixed with 1.6 μl of Lipofectamine 2000 diluted into 50 μl of OptiMEM® and incubated for 30 minutes at room temperature prior to application to the cells. Once applied, the cells are incubated at 37° C. in 5% $CO_2$ for five hours.

Antibodies are premixed with SOST to generate a series of dilutions. One ml of medium for each dilution is prepared, and 450 μl is added to each well after removing transfection mix. The cells are incubated with the antibody-SOST mixtures for 18-20 hours. At the end of the incubation, medium is removed, and 300 μl of 1× Passive Lysis Buffer (Promega, Cat#E194A) is added to lyse cells. Luciferase activity is then measured using Dual-Glo Luciferase System (Promega, Cat#E2940) with 30 μl of lysates in duplicates. Typically, 30 μl of Dual-Glo luciferase (firefly luciferase; for STF) and 30 μl of Dual-Glo Stop and Glo (Renilla luciferase; for transfection efficiency control) substrates is used. Luminescent signals are measured with Mithras LB940 instrument (Berthold Technologies). The ratio of firefly to *Renilla* luciferases is calculated. The final results are expressed by setting the value of Wnt1 without SOST as 1. Additional details of the assay are provided in International Patent Publication No. WO 2009/047356.

Example 2

The following Example illustrates the ability of a sclerostin inhibitor, namely an anti-sclerostin monoclonal antibody (Scl-Ab), to enhance alveolar bone repair in a rat periodontal disease model.

Rat Periodontitis Model:

Experimental periodontal disease was induced in rats by ligature placement as described previously (Jin Q, et al., 2007. J Periodontol 78:1300-1308; Graves, D T, et al., 2008. J Clin Periodontol 35:89-105; the disclosures of which are incorporated herein by reference in their entireties). Briefly, male Sprague Dawley rats (body weight, approx. 300-350 g, Harlan Laboratory, IN) were anesthetized with ketamine and xylazine (83/17 ratio). Cotton suture (3.0) was then secured around the cervical part (just above the gingivae) of the molars on one side of the maxilla, to allow for normal mastication. The ligatures were evaluated three times per week, gently displaced apically into the gingival sulci to ensure a subgingival position, and replaced when necessary.

Microcomputed Tomography (μCT) Scanning and Analysis:

Rats were sacrificed at designated time points. Maxillae were dissected and placed into 10% neutral buffered formalin for 48-72 hrs. Fixed, non-demineralized rat maxillae were scanned in 70% ethanol by a cone beam microCT system (GE Healthcare BioSciences). Linear and volumetric analyses were based on a previously developed methodology (Park C H, et al., 2007. J Periodontol 78:273-281). In brief, each maxillar specimen was scanned and reconstructed at 18×18×18-μm voxels using a μACT system. A three-dimensional (3-D) volume viewer and analyzer software (Microview Analysis, GE Healthcare) were used as the tool for both 3-D and 2-D visualization and quantification. The vertical, linear bone loss was identified by measuring the distance from the cemento-enamel junction (CEJ) to the alveolar bone crest (ABC) of the maxillary second molar. In terms of volumetric analysis, the most mesial root of the first molar (m-M1), the most distal root of the third molar (d-M3), the roof of the furcation, and root apex of M1-M3 were used as reproducible landmarks for assessment of maxillary alveolar bone. Two dimensional regions of interest (ROIs) were drawn at regular intervals (average, eight data slices) on a coronal view and reconstructed as a 3-D structure to quantify volumetric parameters, bone volume fraction (BVF), and bone mineral density (BMD; mg/cc).

Statistical Analysis:

GraphPad Prism (V.5.01) was used to perform the statistic analysis. The differences among groups for linear and volumetric bone measurements were statistically assessed by one-way analysis of variation (ANOVA) with Tukey multiple comparison post hoc test. Data were reported as Mean+ SE, and the level of significance was set as $P \leq 0.05$.

Study Design:

Ten to twelve week old male Sprague-Dawley (SD) rats underwent experimental periodontitis induced by ligature placement as described above. In one mode of study, three days before the ligature placement, animals (n=10/group) were subcutaneously injected once with either saline vehicle or Scl-Ab (dose level of 25 mg/kg). Immediately after the ligature placement, ligated animals or their normal intact controls were treated with either saline vehicle or Scl-Ab. Both Scl-Ab (dose level of 25 mg/kg) and its vehicle control were given by subcutaneous injection twice per week. Necropsy were performed two-week and four-week post-disease induction respectively.

In another mode of study, following four weeks of ligature-induced experimental periodontitis, treatment was commenced immediately following removal of the ligature. Animals (n=10/group) with experimental periodontitis or their normal intact controls were subcutaneously injected twice weekly with either saline vehicle or Scl-Ab (dose level of 25 mg/kg). The treatment lasted for three weeks or six weeks following cessation of disease induction for a total study duration of seven or ten weeks. Body weight measurements were taken weekly prior to Scl-Ab administration until the termination of the study. Necropsies were performed seven-weeks and ten-weeks post-disease induction, respectively. Whole blood (for serum analysis), maxillae and femorae were collected. The study was approved by the Institution Animal Care and Use Committee at University of Michigan.

Figure 2B:
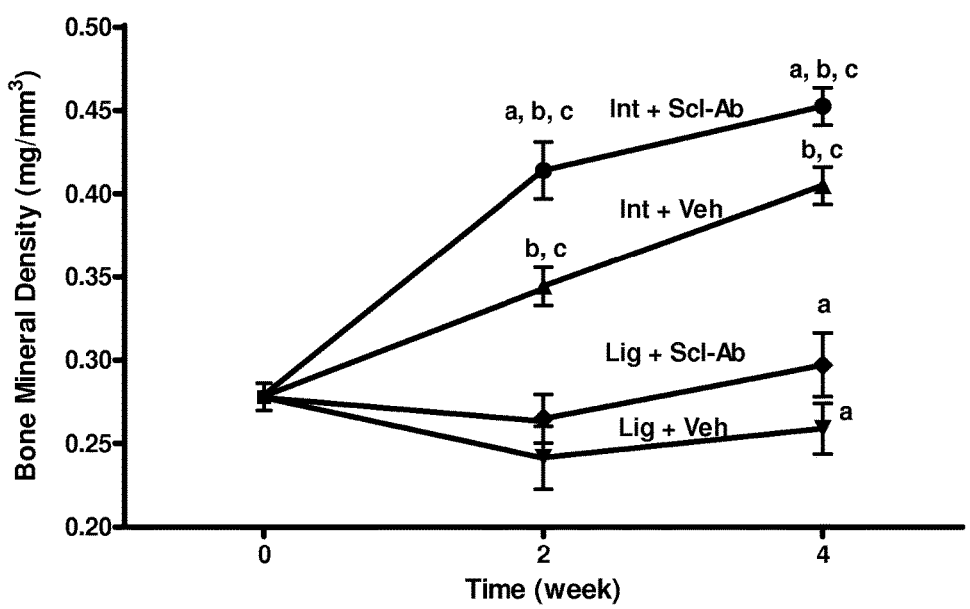
Figure 3A:
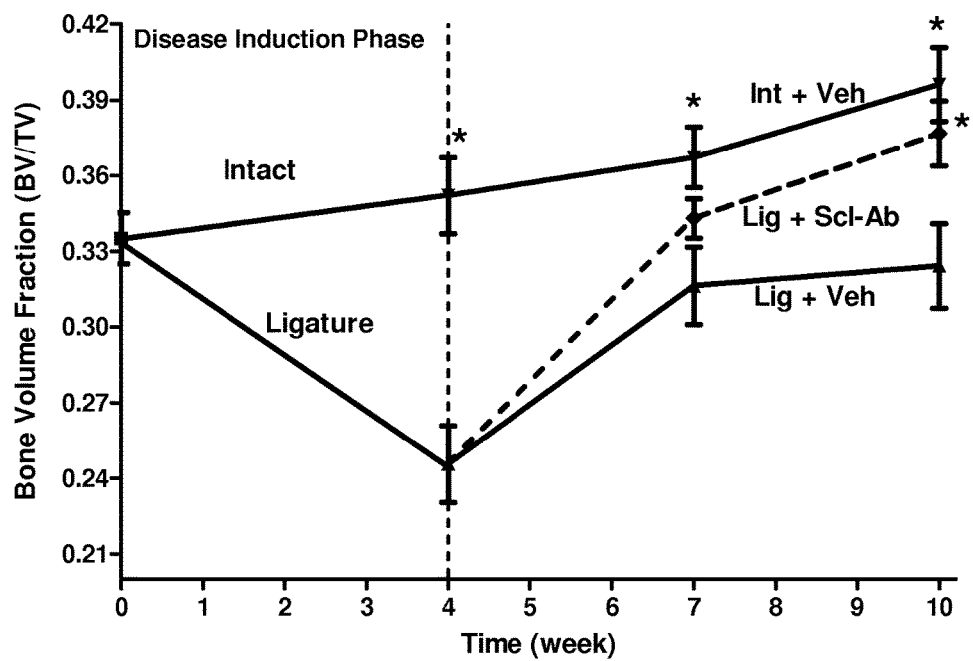
FIGS. 3A and 3B are graphs depicting the effect of systemic administration (measured at the 4-, 7-, and 10-week study endpoints) of an anti-sclerostin antibody on bone volume fraction (FIG. 3A) and bone mineral density (FIG. 3B) after induction of experimental periodontitis.
Figure 3B:
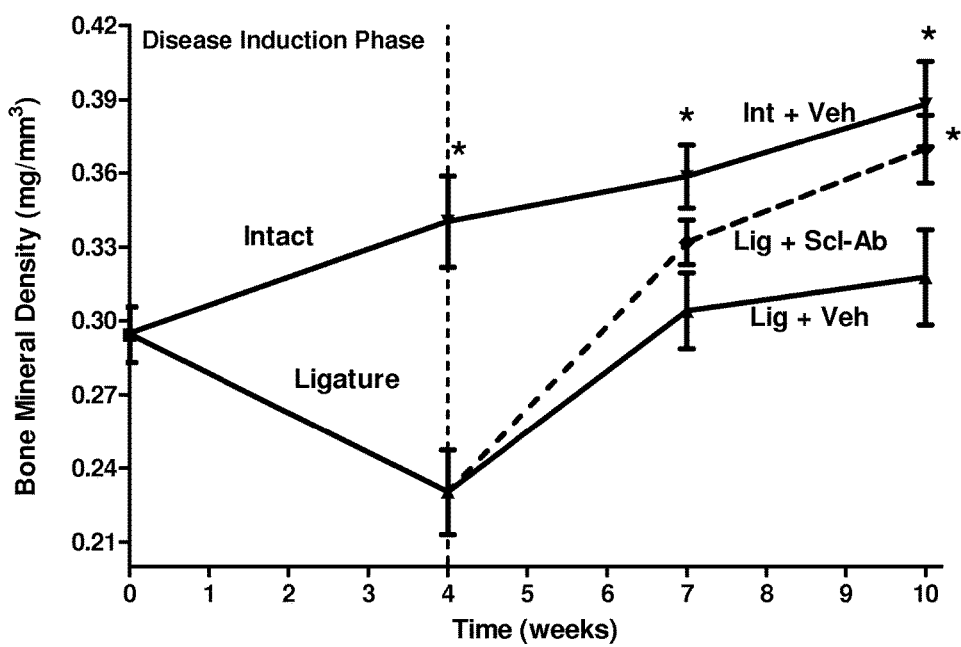

Results:

Maxillary Alveolar Bone:

microCT measurements of supporting alveolar bone volume and density are set forth in FIGS. 2 and 3. In the mode of the study where the ligature was placed throughout the study (two-week and four-week), systemic Scl-Ab administration in the normal intact animal group resulted in a statistically significant increase in both bone volume fraction (BVF) and bone mineral density (BMD) when compared to normal intact animals receiving vehicle injections at two and four weeks following initiation of treatment. Furthermore, ligature-induced periodontal disease groups receiving systemic Scl-Ab injections showed increased BVF and BMD (although not statistically significant) values than the disease group receiving vehicle injections at the two- and four-week time points (FIGS. 2A and 2B).

In the mode of the study where the ligature was removed four-week after placement and immediately before treatment commencement both BVF and BMD showed a statistically significant decrease during the disease induction phase in the experimental periodontitis groups compared to the normal intact animal groups. Within three weeks following cessation of disease induction, BVF and BMD in the vehicle treatment group rebounded and then stabilized until the end of the study. Ligated animals receiving Scl-Ab treatment following induction of experimental periodontitis exhibited improved bone repair (i.e., greater bone volume and density values) throughout the six-week treatment phase compared to animal groups receiving vehicle injections. Most important, after six-weeks of treatment, BVF and BMD were statistically higher in animals treated with Scl-Ab than in vehicle-treated animal group. Furthermore, no statistical difference was found in the bone volume fraction and bone density between the Scl-Ab treated disease animals and vehicle treated normal intact animals at the end of 10-week study, indicating that Scl-Ab may aid in the regeneration of alveolar bone to healthy normal levels following periodontal disease.

Figure 4A:
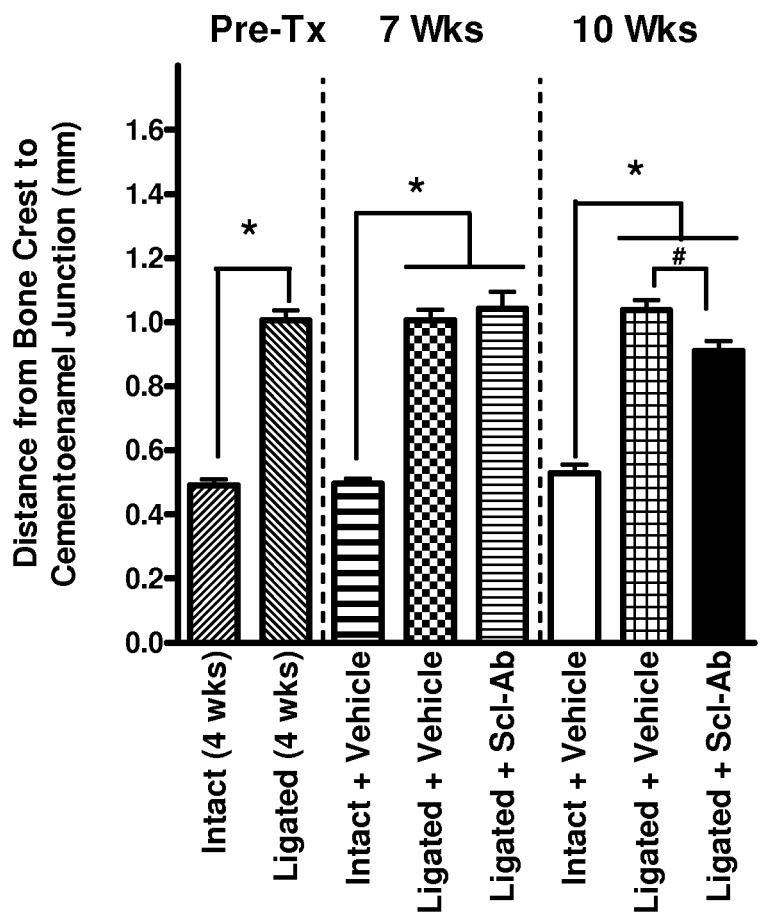
FIG. 4A-4C are graphs depicting the effect of administration of an anti-sclerostin antibody on the distance between cement-enamel junction and the bone crest (FIG. 4A), and site specific measurements for the maxillary second molar at 7 weeks (FIG. 4B) and 10 weeks (FIG. 4C) after induction of experimental periodontitis.
Figure 4B:
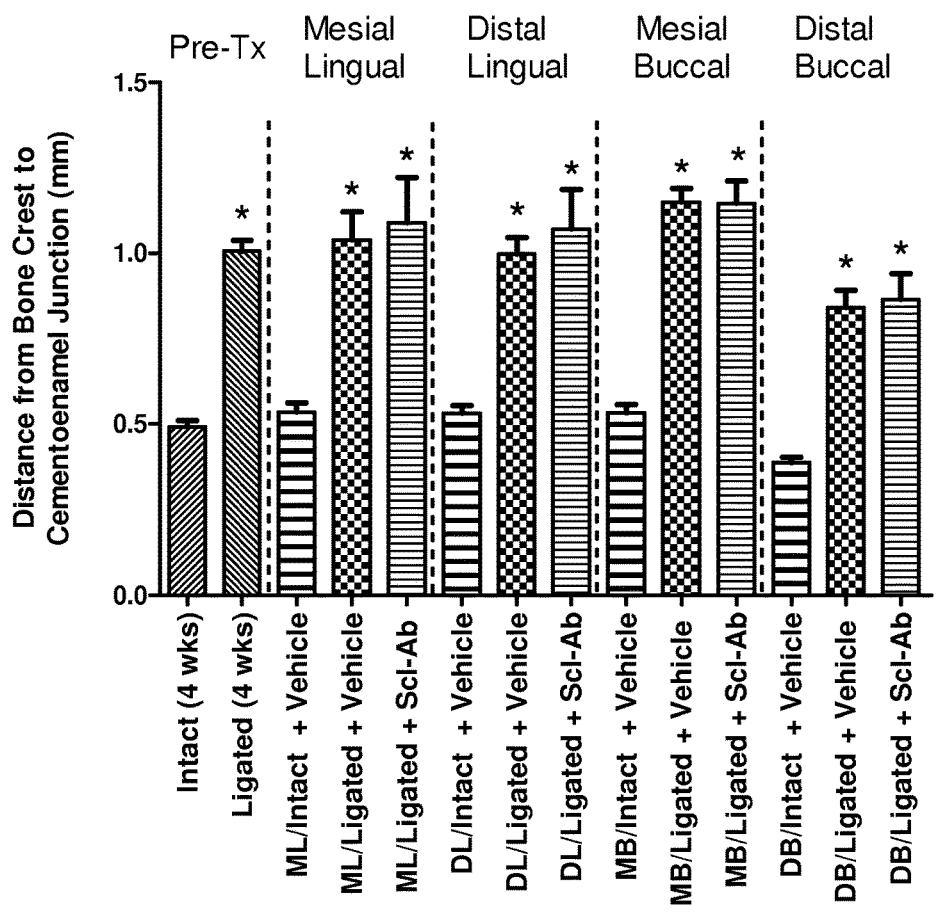
Figure 4C:
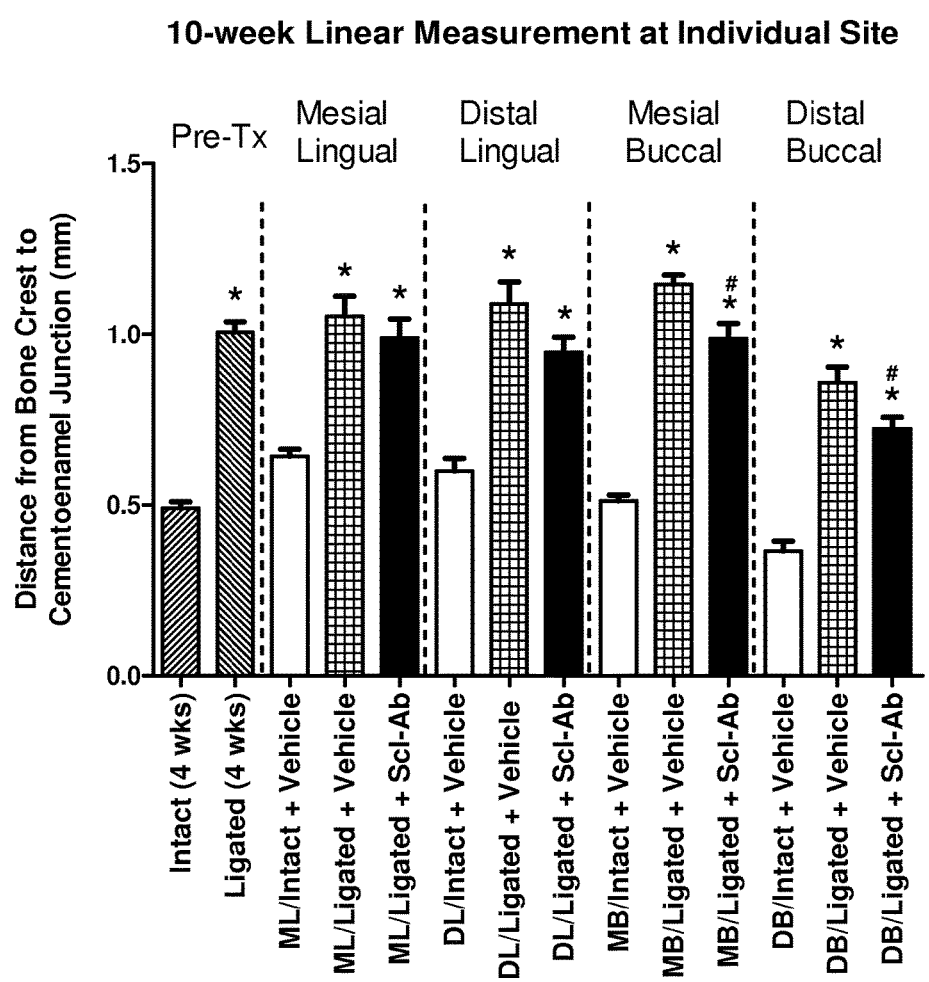

Linear Bone Measurement:

Alveolar bone height was measured from the bone crest to the cement-enamel junction of second molar with microCT assessment (FIG. 4). In the mode of the study where the ligature was removed four-week after placement and immediately before treatment commencement, scl-Ab administration showed some effects on the linear bone repair (i.e., increased alveolar bone height). After three-weeks of treatment, no statistical significance of the linear bone measurement was observed between the Scl-Ab treatment and vehicle groups at the ligated second molar site. However, at the six-week post-treatment time point, Scl-Ab treatment showed an augment in linear bone repair—with a statistically significant difference evident between the vehicle and Scl-Ab treatment groups and vehicle groups at the ligated second molar site (FIGS. 4A-4C).

Systemic administration of Scl-Ab for six weeks following induction of experimental periodontitis resulted in statistically greater BVF and BMD values compared to vehicle treatment as well as statistically similar bone measures to the normal intact group. Thus, systemic Scl-Ab administration contributes to alveolar bone regeneration as measured by BVF and BMD. Scl-Ab may hold promise as a therapeutic to augment and/or accelerate oral bone regeneration.

While this invention has been described with an emphasis upon preferred embodiments, it will be obvious to those of ordinary skill in the art that variations of the preferred compounds and methods may be used and that it is intended that the invention may be practiced otherwise than as specifically described herein. Accordingly, this invention includes all modifications encompassed within the spirit and scope of the invention as defined by the following claims.

SEQUENCE LISTING (809 sequences)

SEQ ID NO: 1 - protein, 190 aa, Homo sapiens
QGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 2 - protein, 14 aa, Homo sapiens
DVSEYSCRELHFTR

SEQ ID NO: 3 - protein, 16 aa, Homo sapiens
SAKPVTELVCSGQCGP

SEQ ID NO: 4 - protein, 17 aa, Homo sapiens
WWRPSGPDFRCIPDRYR

SEQ ID NO: 5 - protein, 12 aa, Homo sapiens
LVASCKCKRLTR

SEQ ID NO: 6 - protein, 26 aa, Homo sapiens
CGPARLLPNAIGRGKWWRPSGPDFRC

SEQ ID NO: 7 - protein, 214 aa, Mus musculus
DVQMIQSPSSLSASLGDIVTMTCQASQGTSINLNWFQQKPGKAPKLLIYGSSNLEDGVPSRFSGSRYGTDFTLTISSLEDEDLATYFCLQHSYLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 8 - DNA, 645 bp, Mus musculus
gatgtccagatgattcagtctccatcctccctgtctgcatctttgggagacatagtcaccatgacttgccaggcaagtcagggcactagcattaatttaaactggtttcagcaaaaaccagggaaggctcctaagctcctgatctatggttcaagcaacttggaagatggggtcccatcaaggttcagtggcagtagatatgggacagatttcactctcaccatcagcagcctggaggatgaagatctggcaacttatttctgtctacaacatagttatctcccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 9 - protein, 236 aa, Mus musculus
MNTRAPAEFLGFLLLWFLGARCDVQMIQSPSSLSASLGDIVTMTCQASQGTSINLNWFQQKPGKAPKLLIYGSSNLEDGVPSRFSGSRYGTDFTLTISSLEDEDLATYFCLQHSYLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 10 - DNA, 711 bp, Mus musculus
atgaacacgagggcccctgctgagttccttgggttcctgttgctctggtttttaggtgccagatgtgatgtccagatgattcagtctccatcctccctgtctgcatctttgggagacatagtcaccatgacttgccaggcaagtcagggcactagcattaatttaaactggtttcagcaaaaaccagggaaggctcctaagctcctgatctatggttcaagcaacttggaagatggggtcccatcaaggttcagtggcagtagatatgggacagatttcactctcaccatcagcagcctggaggatgaagatctggcaacttatttctgtctacaacatagttatctcccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 11 - protein, 443 aa, Mus musculus
EVQLQQSGPELVTPGASVKISCKASGYTFTDHYMSWVKQSHGKSLEWIGDINPYSGETTYNQKFKGTATLTVDKSSSIAYMEIRGLTSEDSAVYYCARDDYDASPFAYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSPAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 12 - DNA, 1332 bp, Mus musculus
gaggtccagctgcaacagtctggacctgaactggtgacgcctggggcttcagtgaagatatcttgtaaggcttctggatacacattcactgaccactacatgagctgggtgaagcagagtcatggaaaaagccttgagtggattggagatattaatccctattctggtgaaactacctacaaccagaagttcaagggcacggccacattgactgtagacaagtcttccagtatagcctacatggagatccgcggcctgacatctgaggactctgcagtctattactgtgcaagagatgattacgacgcctctccgtttgcttactggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtccagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 13 - protein, 462 aa, Mus musculus
MRCRWIFLFLLSGTAGVLSEVQLQQSGPELVTPGASVKISCKASGYTFTDHYMSWVKQSHGKSLEWIGDINPYSGETTYNQKFKGTATLTVDKSSSIAYMEIRGLTSEDSAVYYCARDDYDASPFAYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSPAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 14 - DNA, 1389 bp, Mus musculus
atgagatgcaggtggatctttctctttctcctgtcaggaactgcaggtgtcctctctgaggtccagctgcaacagtctggacctgaactggtgacgcctggggcttcagtgaagatatcttgtaaggcttctggatacacattcactgaccactacatgagctgggtgaagcagagtcatggaaaaagccttgagtggattggagatattaatccctattctggtgaaactacctacaaccagaagttcaagggcacggccacattgactgtagacaagtcttccagtatagcctacatggagatccgcggcctgacatctgaggactctgcagtctattactgtgcaagagatgattacgacgcctctccgtttgcttactggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtccagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 15 - protein, 218 aa, Mus musculus
DIVLTQSPASLTVSLGLRATISCKASQSVDYDGDSYMNWYQQKPGQPPKLLIYAASNLESGIPARFSGNGSGTDFTLNIHPVEEEDAVTYYCQQSNEDPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 16 - DNA, 657 bp, Mus musculus
gacattgtgctgacccaatctccagcttctttgactgtgtctctaggcctgagggccaccatctcctgcaaggccagccaaagtgttgattatgatggtgatagttatatgaactggtaccagcagaaaccaggacagccacccaaactcctcatctatgctgcatccaatctagaatctgggatcccagccaggtttagtggcaatgggtctgggacagacttcaccctcaacatccatcctgtggaggaggaggatgctgtaacctattactgtcaacaaagtaatgaggatccgtggacgttcggtggaggcaccaagctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 17 - protein, 238 aa, Mus musculus
METDTILLWVLLLWVPGSTGDIVLTQSPASLTVSLGLRATISCKASQSVDYDGDSYMNWYQQKPGQPPKLLIYAASNLESGIPARFSGNGSGTDFTLNIHPVEEEDAVTYYCQQSNEDPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 18 - DNA, 717 bp, Mus musculus
atggagacagacacaatcctgctatgggtgctgctgctctgggttccaggctccactggtgacattgtgctgacccaatctccagcttctttgactgtgtctctaggcctgagggccaccatctcctgcaaggccagccaaagtgttgattatgatggtgatagttatatgaactggtaccagcagaaaccaggacagccacccaaactcctcatctatgctgcatccaatctagaatctgggatcccagccaggtttagtggcaatgggtctgggacagacttcaccctcaacatccatcctgtggaggaggaggatgctgtaacctattactgtcaacaaagtaatgaggatccgtggacgttcggtggaggcaccaagctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 19 - protein, 449 aa, Mus musculus
EVQLQQSGPELVKPGTSVKMSCKASGYTFTDCYMNWVKQSHGKSLEWIGDINPFNGGTTYNQKFKGKATLTVDKSSSTAYMQLNSLTSDDSAVYYCARSHYYFDGRVPWDAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 20 - DNA, 1350 bp, Mus musculus
gaggtccagctgcaacaatctggacctgagctggtgaagcctgggacttcagtgaagatgtcctgtaaggcttctggatacacattcactgactgctacatgaactgggtgaagcagagccatgggaagagccttgaatggattggagatattaatcctttcaacggtggtactacctacaaccagaagttcaagggcaaggccacattgactgtagacaaatcctccagcacagcctacatgcagctcaacagcctgacatctgacgactctgcagtctattactgtgcaagatcccattattacttcgatggtagagtcccttgggatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 21 - protein, 468 aa, Mus musculus
MGWNWIFLFLLSGTAGVYSEVQLQQSGPELVKPGTSVKMSCKASGYTFTDCYMNWVKQSHGKSLEWIGDINPFNGGTTYNQKFKGKATLTVDKSSSTAYMQLNSLTSDDSAVYYCARSHYYFDGRVPWDAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 22 - DNA, 1407 bp, Mus musculus
atgggatggaactggatctttctcttcctcttgtcaggaactgcaggtgtctactctgaggtccagctgcaacaatctggacctgagctggtgaagcctgggacttcagtgaagatgtcctgtaaggcttctggatacacattcactgactgctacatgaactgggtgaagcagagccatgggaagagccttgaatggattggagatattaatcctttcaacggtggtactacctacaaccagaagttcaagggcaaggccacattgactgtagacaaatcctccagcacagcctacatgcagctcaacagcctgacatctgacgactctgcagtctattactgtgcaagatcccattattacttcgatggtagagtcccttgggatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 23 - protein, 217 aa, Artificial Sequence
  Synthetic Polypeptide
  MISC_FEATURE: Rabbit-mouse chimera
AQVLTQTPASVSAAVGGTVTINCQSSQSVYDNNWLAWFQQKPGQPPKLLIYDASDLASGVPSRFSGSGSGTQFTLTISGVQCADAATYYCQGAYNDVIYAFGGGTEVVVKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 24 - DNA, 654 bp, Artificial Sequence
  Synthetic Polynucleotide
  misc_feature: Rabbit-mouse chimera
gcgcaagtgctgacccagactccagcctccgtgtctgcagctgtgggaggcacagtcaccatcaattgccagtccagtcagagtgtttatgataacaactggttagcctggtttcagcagaaaccagggcagcctcccaagctcctgatttatgatgcatccgatctggcatctggggtcccatcgcggttcagtggcagtggatctgggacacagttcactctcaccatcagcggcgtgcagtgtgccgatgctgccacttactactgtcaaggcgcttataatgatgttatttatgctttcggcggagggaccgaggtggtggtcaaacgtacggatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 25 - protein, 239 aa, Artificial Sequence
  Synthetic Polypeptide
  MISC_FEATURE: Rabbit-mouse chimera
MDTRAPTQLLGLLLLWLPGATFAQVLTQTPASVSAAVGGTVTINCQSSQSVYDNNWLAWFQQKPGQPPKLLIYDASDLASGVPSRFSGSGSGTQFTLTISGVQCADAATYYCQGAYNDVIYAFGGGTEVVVKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 26 - DNA, 720 bp, Artificial Sequence
  Synthetic polynucleotide
  misc_feature: Rabbit-mouse chimera
atggacacgagggcccccactcagctgctggggctcctgctgctctggctcccaggtgccacatttgcgcaagtgctgacccagactccagcctccgtgtctgcagctgtgggaggcacagtcaccatcaattgccagtccagtcagagtgtttatgataacaactggttagcctggtttcagcagaaaccagggcagcctcccaagctcctgatttatgatgcatccgatctggcatctggggtcccatcgcggttcagtggcagtggatctgggacacagttcactctcaccatcagcggcgtgcagtgtgccgatgctgccacttactactgtcaaggcgcttataatgatgttatttatgctttcggcggagggaccgaggtggtggtcaaacgtacggatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 27 - protein, 433 aa, Artificial Sequence
  Synthetic Polypeptide
  MISC_FEATURE: Humanized Antibody
QSLEESGGRLVTPGTPLTLTCTASGFSLSSYWMNWVRQAPGEGLEWIGTIDSGGRTDYASWAKGRFTISRTSTTMDLKMTSLTTGDTARYFCARNWNLWGQGTLVTVSSASTKGPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 28 - DNA, 1302 bp, Artificial Sequence
  Synthetic Polynucleotide
  misc_feature: Humanized Antibody
cagtcgctggaggagtccgggggtcgcctggtcacgcctgggacacccctgacactcacctgcacagcctctggattctccctcagtagttattggatgaactgggtccgccaggctccaggggaggggctggaatggatcggaaccattgattctggtggtaggacggactacgcgagctgggcaaaaggccgattcaccatctccagaacctcgactacgatggatctgaaaatgaccagtctgacgaccggggacacggcccgttatttctgtgccagaaattggaacttgtggggccaaggcaccctcgtcaccgtctcgagcgcttctacaaagggcccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 29 - protein, 452 aa, Artificial Sequence
  Synthetic Polypeptide
  MISC_FEATURE: Humanized Antibody
METGLRWLLLVAVLKGVHCQSLEESGGRLVTPGTPLTLTCTASGFSLSSYWMNWVRQAPGEGLEWIGTIDSGGRTDYASWAKGRFTISRTSTTMDLKMTSLTTGDTARYFCARNWNLWGQGTLVTVSSASTKGPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 30 - DNA, 1359 bp, Artificial Sequence
  Synthetic Polynucleotide
  misc_feature: Humanized Antibody
atggagactgggctgcgctggcttctcctggtcgctgtgctcaaaggtgtccactgtcagtcgctggaggagtccgggggtcgcctggtcacgcctgggacacccctgacactcacctgcacagcctctggattctccctcagtagttattggatgaactgggtccgccaggctccaggggaggggctggaatggatcggaaccattgattctggtggtaggacggactacgcgagctgggcaaaaggccgattcaccatctccagaacctcgactacgatggatctgaaaatgaccagtctgacgaccggggacacggcccgttatttctgtgccagaaattggaacttgtggggccaaggcaccctcgtcaccgtctcgagcgcttctacaaagggcccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 31 - protein, 213 aa, Mus musculus
QIVLTQSPTIVSASPGEKVTLICSASSSVSFVDWFQQKPGTSPKRWIYRTSNLGFGVPARFSGGGSGTSHSLTISRMEAEDAATYYCQQRSTYPPTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 32 - DNA, 642 bp, Mus musculus
caaattgttctcacccagtctccaacaatcgtgtctgcatctccaggggagaaggtcaccctaatctgcagtgccagttcaagtgtaagtttcgtggactggttccagcagaagccaggcacttctcccaaacgctggatttacagaacatccaacctgggttttggagtccctgctcgcttcagtggcggtggatctgggacctctcactctctcacaatcagccgaatggaggctgaagatgctgccacttattactgccagcaaaggagtacttacccacccacgttcggtgctgggaccaagctggaactgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 33 - protein, 235 aa, Mus musculus
MHFQVQIFSFLLISASVIVSRGQIVLTQSPTIVSASPGEKVTLICSASSSVSFVDWFQQKPGTSPKRWIYRTSNLGFGVPARFSGGGSGTSHSLTISRMEAEDAATYYCQQRSTYPPTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 34 - DNA, 708 bp, Mus musculus
atgcattttcaagtgcagattttcagcttcctgctaatcagtgcctcagtcatagtgtccagagggcaaattgttctcacccagtctccaacaatcgtgtctgcatctccaggggagaaggtcaccctaatctgcagtgccagttcaagtgtaagtttcgtggactggttccagcagaagccaggcacttctcccaaacgctggatttacagaacatccaacctgggttttggagtccctgctcgcttcagtggcggtggatctgggacctctcactctctcacaatcagccgaatggaggctgaagatgctgccacttattactgccagcaaaggagtacttacccacccacgttcggtgctgggaccaagctggaactgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 35 - protein, 449 aa, Mus musculus
QVTLKESGPGILQPSQTLSLTCSFSGFSLSTSGMGVGWIRHPSGKNLEWLAHIWWDDVKRYNPVLKSRLTISKDTSNSQVFLKIANVDTADTATYYCARIEDFDYDEEYYAMDYWGQGTSVIVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 36 - DNA, 1350 bp, Mus musculus
caggttactctgaaagagtctggccctgggatattgcagccctcccagaccctcagtctgacttgttctttctctgggttttcactgagcacttctggtatgggtgtaggctggattcgtcacccatcagggaagaatctggagtggctggcacacatttggtgggatgatgtcaagcgctataacccagtcctgaagagccgactgactatctccaaggatacctccaacagccaggtattcctcaagatcgccaatgtggacactgcagatactgccacatactactgtgctcgaatagaggactttgattacgacgaggagtattatgctatggactactggggtcaaggaacctcagtcatcgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 37 - protein, 468 aa, Mus musculus
MGRLTSSFLLLIVPAYVLSQVTLKESGPGILQPSQTLSLTCSFSGFSLSTSGMGVGWIRHPSGKNLEWLAHIWWDDVKRYNPVLKSRLTISKDTSNSQVFLKIANVDTADTATYYCARIEDFDYDEEYYAMDYWGQGTSVIVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 38 - DNA, 1407 bp, Mus musculus
atgggcaggcttacttcttcattcctgctactgattgtccctgcatatgtcctgtcccaggttactctgaaagagtctggccctgggatattgcagccctcccagaccctcagtctgacttgttctttctctgggttttcactgagcacttctggtatgggtgtaggctggattcgtcacccatcagggaagaatctggagtggctggcacacatttggtgggatgatgtcaagcgctataacccagtcctgaagagccgactgactatctccaaggatacctccaacagccaggtattcctcaagatcgccaatgtggacactgcagatactgccacatactactgtgctcgaatagaggactttgattacgacgaggagtattatgctatggactactggggtcaaggaacctcagtcatcgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 39 - protein, 5 aa, Mus musculus
DHYMS

SEQ ID NO: 40 - protein, 17 aa, Mus musculus
DINPYSGETTYNQKFKG

SEQ ID NO: 41 - protein, 10 aa, Mus musculus
DDYDASPFAY

SEQ ID NO: 42 - protein, 11 aa, Mus musculus
QASQGTSINLN

SEQ ID NO: 43 - protein, 7 aa, Mus musculus
GSSNLED

SEQ ID NO: 44 - protein, 9 aa, Mus musculus
LQHSYLPYT

SEQ ID NO: 45 - protein, 5 aa, Mus musculus
DCYMN

SEQ ID NO: 46 - protein, 17 aa, Mus musculus
DINPFNGGTTYNQKFKG

SEQ ID NO: 47 - protein, 16 aa, Mus musculus
SHYYFDGRVPWDAMDY

SEQ ID NO: 48 - protein, 15 aa, Mus musculus
KASQSVDYDGDSYMN

SEQ ID NO: 49 - protein, 7 aa, Mus musculus
AASNLES

SEQ ID NO: 50 - protein, 9 aa, Mus musculus
QQSNEDPWT

SEQ ID NO: 51 - protein, 5 aa, Artificial Sequence
  Synthetic Polypeptide
  MISC_FEATURE: Rabbit-mouse chimera
SYWMN

SEQ ID NO: 52 - protein, 16 aa, Artificial Sequence
  Synthetic Polypeptide
  MISC_FEATURE: Rabbit-mouse chimera
TIDSGGRTDYASWAKG

SEQ ID NO: 53 - protein, 4 aa, Artificial Sequence
  Rabbit-Mouse Chimera
NWNL

SEQ ID NO: 54 - protein, 13 aa, Artificial Sequence
  Synthetic Polypeptide
  MISC_FEATURE: Rabbit-mouse chimera
QSSQSVYDNNWLA

SEQ ID NO: 55 - protein, 7 aa, Artificial Sequence
  Synthetic Polypeptide
  MISC_FEATURE: Rabbit-mouse chimera
DASDLAS

SEQ ID NO: 56 - protein, 10 aa, Artificial Sequence
  Synthetic Polypeptide
  MISC_FEATURE: Rabbit-mouse chimera
QGAYNDVIYA

SEQ ID NO: 57 - protein, 7 aa, Mus musculus
TSGMGVG

SEQ ID NO: 58 - protein, 16 aa, Mus musculus
HIWWDDVKRYNPVLKS

SEQ ID NO: 59 - protein, 14 aa, Mus musculus
EDFDYDEEYYAMDY

SEQ ID NO: 60 - protein, 10 aa, Mus musculus
SASSSVSFVD

SEQ ID NO: 61 - protein, 7 aa, Mus musculus
RTSNLGF

SEQ ID NO: 62 - protein, 9 aa, Mus musculus
QQRSTYPPT

SEQ ID NO: 63 - protein, 20 aa, Homo sapiens
CGPARLLPNAIGRGKWWRPS

SEQ ID NO: 64 - protein, 20 aa, Homo sapiens
GPARLLPNAIGRGKWWRPSG

SEQ ID NO: 65 - protein, 20 aa, Homo sapiens
PARLLPNAIGRGKWWRPSGP

SEQ ID NO: 66 - protein, 20 aa, Homo sapiens
ARLLPNAIGRGKWWRPSGPD

SEQ ID NO: 67 - protein, 20 aa, Homo sapiens
RLLPNAIGRGKWWRPSGPDF

SEQ ID NO: 68 - protein, 20 aa, Homo sapiens
LLPNAIGRGKWWRPSGPDFR

SEQ ID NO: 69 - protein, 20 aa, Homo sapiens
LPNAIGRGKWWRPSGPDFRC

SEQ ID NO: 70 - protein, 14 aa, Homo sapiens
SAKPVTELVCSGQC

SEQ ID NO: 71 - protein, 7 aa, Homo sapiens
LVASCKC

SEQ ID NO: 72 - protein, 8 aa, Homo sapiens
CRELHFTR

SEQ ID NO: 73 - protein, 7 aa, Homo sapiens
CIPDRYR

SEQ ID NO: 74 - DNA, 399 bp, Artificial Sequence
  Synthetic Polynucleotide
  misc_feature: Humanized Antibody Sequence
atggacacgagggcccccactcagctgctggggctcctgctgctctggctcccaggtgccacatttgctcaagttctgacccagagtccaagcagtctctccgccagcgtaggcgatcgtgtgactattacctgtcaatctagtcagagcgtgtatgataacaattggctggcgtggtaccagcaaaaaccgggcaaagccccgaagctgctcatctatgacgcgtccgatctggctagcggtgtgccaagccgtttcagtggcagtggcagcggtactgactttaccctcacaatttcgtctctccagccggaagatttcgccacttactattgtcaaggtgcttacaacgatgtgatttatgccttcggtcagggcactaaagtagaaatcaaacgt

SEQ ID NO: 75 - protein, 133 aa, Artificial Sequence
  Synthetic Polypeptide
  MISC_FEATURE: Humanized Antibody Sequence
MDTRAPTQLLGLLLLWLPGATFAQVLTQSPSSLSASVGDRVTITCQSSQSVYDNNWLAWYQQKPGKAPKLLIYDASDLASGVPSRFSGSGSGTDFTLTISSLQPEDFATYYCQGAYNDVIYAFGQGTKVEIKR

SEQ ID NO: 76 - DNA, 393 bp, Artificial Sequence
  Synthetic Polynucleotide
  misc_feature: Humanized Antibody Sequence
atggagactgggctgcgctggcttctcctggtcgctgtgctcaaaggtgtccactgtgaggtgcagctgttggagtctggaggcgggcttgtccagcctggagggagcctgcgtctctcttgtgcagcaagcggcttcagcttatcctcttactggatgaattgggtgcggcaggcacctgggaagggcctggagtgggtgggcaccattgattccggaggccgtacagactacgcgtcttgggcaaagggccgtttcaccatttcccgcgacaactccaaaaataccatgtacctccagatgaactctctccgcgcagaggacacagcacgttattactgtgcacgcaactggaatctgtggggtcaaggtactcttgtaacagtctcgagc

SEQ ID NO: 77 - protein, 131 aa, Artificial Sequence
  Synthetic Polypeptide
  MISC_FEATURE: Humanized Antibody Sequence
METGLRWLLLVAVLKGVHCEVQLLESGGGLVQPGGSLRLSCAASGFSLSSYWMNWVRQAPGKGLEWVGTIDSGGRTDYASWAKGRFTISRDNSKNTMYLQMNSLRAEDTARYYCARNWNLWGQGTLVTVSS

SEQ ID NO: 78 - protein, 11 aa, Mus musculus
RASQDISNYLN

SEQ ID NO: 79 - protein, 7 aa, Mus musculus
YTSRLLS

SEQ ID NO: 80 - protein, 9 aa, Mus musculus
QQGDTLPYT

SEQ ID NO: 81 - protein, 11 aa, Mus musculus
RASQDISNYLN

SEQ ID NO: 82 - protein, 24 aa, Rattus norvegicus
QGWQAFKNDATEIIPGLREYPEPP

SEQ ID NO: 83 - protein, 20 aa, Rattus norvegicus
TEIIPGLREYPEPPQELENN

SEQ ID NO: 84 - protein, 20 aa, Rattus norvegicus
PEPPQELENNQTMNRAENGG

SEQ ID NO: 85 - protein, 20 aa, Rattus norvegicus
ENGGRPPHHPYDTKDVSEYS

SEQ ID NO: 86 - protein, 14 aa, Rattus norvegicus
CRELHYTRFVTDGP

SEQ ID NO: 87 - protein, 25 aa, Rattus norvegicus
CRELHYTRFVTDGPSRSAKPVTELV

SEQ ID NO: 88 - protein, 23 aa, Rattus norvegicus
CRSAKPVTELVSSGQSGPRARLL

SEQ ID NO: 89 - protein, 25 aa, Rattus norvegicus
CGPARLLPNAIGRVKWWRPNGPDFR

SEQ ID NO: 90 - protein, 20 aa, Rattus norvegicus
RAQRVQLLCPGGAAPRSRKV

SEQ ID NO: 91 - protein, 16 aa, Rattus norvegicus
PGGAAPRSRKVRLVAS

SEQ ID NO: 92 - protein, 23 aa, Rattus norvegicus
KRLTRFHNQSELKDFGPETARPQ

SEQ ID NO: 93 - protein, 16 aa, Rattus norvegicus
IPDRYAQRVQLLSPGG

SEQ ID NO: 94 - protein, 24 aa, Rattus norvegicus
SELKDFGPETARPQKGRKPRPRAR

SEQ ID NO: 95 - protein, 23 aa, Rattus norvegicus
KGRKPRPRARGAKANQAELENAY

SEQ ID NO: 96 - protein, 18 aa, Rattus norvegicus
PNAIGRVKWWRPNGPDFR

SEQ ID NO: 97 - protein, 22 aa, Rattus norvegicus
KWWRPNGPDFRCIPDRYRAQRV

SEQ ID NO: 98 - protein, 213 aa, Rattus norvegicus
MQLSLAPCLACLLVHAAFVAVESQGWQAFKNDATEIIPGLREYPEPPQELENNQTMNRAENGGRPPHHPYDTKDVSEYSCRELHYTRFVTDGPCRSAKPVTELVCSGQCGPARLLPNAIGRVKWWRPNGPDFRCIPDRYRAQRVQLLCPGGAAPRSRKVRLVASCKCKRLTRFHNQSELKDFGPETARPQKGRKPRPRARGAKANQAELENAY

SEQ ID NO: 99 - protein, 7 aa, Mus musculus
YTSRLHS

SEQ ID NO: 100 - protein, 9 aa, Mus musculus
QQGDTLPYT

SEQ ID NO: 101 - protein, 11 aa, Mus musculus
RASQVITNYLY

SEQ ID NO: 102 - protein, 7 aa, Mus musculus
YTSRLHS

SEQ ID NO: 103 - protein, 9 aa, Mus musculus
QQGDTLPYT

SEQ ID NO: 104 - protein, 11 aa, Mus musculus
RASQDISNYLN

SEQ ID NO: 105 - protein, 7 aa, Mus musculus
YTSRLLS

SEQ ID NO: 106 - protein, 9 aa, Mus musculus
QQGDTLPYT

SEQ ID NO: 107 - protein, 11 aa, Mus musculus
RASQDISNYLN

SEQ ID NO: 108 - protein, 7 aa, Mus musculus
YTSRLFS

SEQ ID NO: 109 - protein, 9 aa, Mus musculus
QQGDTLPYT

SEQ ID NO: 110 - protein, 11 aa, Mus musculus
RASQDISNYLN

SEQ ID NO: 111 - protein, 7 aa, Mus musculus
YTSRLLS

SEQ ID NO: 112 - protein, 9 aa, Mus musculus
QQGDTLPYT

SEQ ID NO: 113 - protein, 11 aa, Mus musculus
RASQDISNYLN

SEQ ID NO: 114 - protein, 7 aa, Mus musculus
YTSTLQS

SEQ ID NO: 115 - protein, 9 aa, Mus musculus
QQGDTLPYT

SEQ ID NO: 116 - protein, 12 aa, Mus musculus
SVSSSISSSNLH

SEQ ID NO: 117 - protein, 213 aa, Mus musculus
QIVLSQSPAILSTSPGEKVTMTCRASSSVYYMHWYQQKPGSSPKPWIYATSNLASGVPVRFSGSGSGTSYSLTITRVEAEDAATYYCQQWSSDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 118 - DNA, 642 bp, Mus musculus
caaattgttctctcccagtctccagcaatcctgtctacatctccaggggagaaggtcacaatgacttgcagggccagctcaagtgtatattacatgcactggtaccagcagaagccaggatcctcccccaaaccctggatttatgccacatccaacctggcttctggagtccctgttcgcttcagtggcagtgggtctgggacctcttactctctcacaatcaccagagtggaggctgaagatgctgccacttattactgccagcagtggagtagtgacccactcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 119 - protein, 235 aa, Mus musculus
MDFQVQIFSFLLISASVIMSRGQIVLSQSPAILSTSPGEKVTMTCRASSSVYYMHWYQQKPGSSPKPWIYATSNLASGVPVRFSGSGSGTSYSLTITRVEAEDAATYYCQQWSSDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 120 - DNA, 708 bp, Mus musculus
atggattttcaagtgcagattttcagcttcctgctaatcagtgcttcagtcattatgtccaggggacaaattgttctctcccagtctccagcaatcctgtctacatctccaggggagaaggtcacaatgacttgcagggccagctcaagtgtatattacatgcactggtaccagcagaagccaggatcctcccccaaaccctggatttatgccacatccaacctggcttctggagtccctgttcgcttcagtggcagtgggtctgggacctcttactctctcacaatcaccagagtggaggctgaagatgctgccacttattactgccagcagtggagtagtgacccactcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 121 - protein, 445 aa, Mus musculus
EVQVQQSGPELVKPGASVKLSCTASGFNIKDYFIHWVKQRPEQGLEWIGRLDPEDGESDYAPKFQDKAIMTADTSSNTAYLQLRSLTSEDTAIYYCEREDYDGTYTFFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 122 - DNA, 1338 bp, Mus musculus
gaggttcaggtgcagcagtctgggccagaacttgtgaagccaggggcctcagtcaagttgtcctgcacagcttctggcttcaacattaaagactactttatacactgggtgaagcagaggcctgaacagggcctggagtggattggaaggcttgatcctgaggatggtgaaagtgattatgccccgaagttccaggacaaggccattatgacagcagacacatcatccaacacagcctatcttcagctcagaagcctgacatctgaggacactgccatctattattgtgagagagaggactacgatggtacctacaccttttttccttactggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 123 - protein, 464 aa, Mus musculus
MKCSWVIFFLMAVVTGVNSEVQVQQSGPELVKPGASVKLSCTASGFNIKDYFIHWVKQRPEQGLEWIGRLDPEDGESDYAPKFQDKAIMTADTSSNTAYLQLRSLTSEDTAIYYCEREDYDGTYTFFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 124 - DNA, 1395 bp, Mus musculus
atgaaatgcagctgggtcatcttcttcctgatggcagtggttacaggggtcaattcagaggttcaggtgcagcagtctgggccagaacttgtgaagccaggggcctcagtcaagttgtcctgcacagcttctggcttcaacattaaagactactttatacactgggtgaagcagaggcctgaacagggcctggagtggattggaaggcttgatcctgaggatggtgaaagtgattatgccccgaagttccaggacaaggccattatgacagcagacacatcatccaacacagcctatcttcagctcagaagcctgacatctgaggacactgccatctattattgtgagagagaggactacgatggtacctacaccttttttccttactggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 125 - protein, 215 aa, Mus musculus
EIVLTQSPALMAASPGEKVTITCSVSSTISSNHLHWFQQKSDTSPKPWIYGTSNLASGVPVRFSGSGSGTSYSLTISSMEAEDAATYYCQQWSSYPLTFGAGTKLELRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 126 - DNA, 648 bp, Mus musculus
gaaattgtgctcacccagtctccagcactcatggctgcatctccgggggagaaggtcaccatcacctgcagtgtcagttcaactataagttccaaccacttgcactggttccagcagaagtcagacacctcccccaaaccctggatttatggcacatccaacctggcttctggagtccctgttcgcttcagtggcagtggatctgggacctcttattctctcacaatcagcagcatggaggctgaggatgctgccacttattactgtcaacagtggagtagttacccactcacgttcggcgctgggaccaagctggagctgagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 127 - protein, 237 aa, Mus musculus
MDFHVQIFSFMLISVTVILSSGEIVLTQSPALMAASPGEKVTITCSVSSTISSNHLHWFQQKSDTSPKPWIYGTSNLASGVPVRFSGSGSGTSYSLTISSMEAEDAATYYCQQWSSYPLTFGAGTKLELRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 128 - DNA, 714 bp, Mus musculus
atggattttcatgtgcagattttcagcttcatgctaatcagtgtcacagtcattttgtccagtggagaaattgtgctcacccagtctccagcactcatggctgcatctccgggggagaaggtcaccatcacctgcagtgtcagttcaactataagttccaaccacttgcactggttccagcagaagtcagacacctcccccaaaccctggatttatggcacatccaacctggcttctggagtccctgttcgcttcagtggcagtggatctgggacctcttattctctcacaatcagcagcatggaggctgaggatgctgccacttattactgtcaacagtggagtagttacccactcacgttcggcgctgggaccaagctggagctgagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 129 - protein, 449 aa, Mus musculus
EVQLQQSGAELVRPGALVKLSCTASDFNIKDFYLHWMRQRPEQGLDWIGRIDPENGDTLYDPKFQDKATLTTDTSSNTAYLQLSGLTSETTAVYYCSREADYFHDGTSYWYFDVWGAGTTITVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 130 - DNA, 1350 bp, Mus musculus
gaggttcagctgcagcagtctggggctgaacttgtgaggccaggggccttagtcaagttgtcctgcacagcttctgacttcaacattaaagacttctatctacactggatgaggcagcggcctgaacagggcctggactggattggaaggattgatcctgagaatggtgatactttatatgacccgaagttccaggacaaggccactcttacaacagacacatcctccaacacagcctacctgcagctcagcggcctgacatctgagaccactgccgtctattactgttctagagaggcggattatttccacgatggtacctcctactggtacttcgatgtctggggcgcagggaccacaatcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 131 - protein, 468 aa, Mus musculus
MKCSWVIFFLMAVVTGVNSEVQLQQSGAELVRPGALVKLSCTASDFNIKDFYLHWMRQRPEQGLDWIGRIDPENGDTLYDPKFQDKATLTTDTSSNTAYLQLSGLTSETTAVYYCSREADYFHDGTSYWYFDVWGAGTTITVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 132 - DNA, 1407 bp, Mus musculus
atgaaatgcagctgggtcatcttcttcctgatggcagtggttacaggggtcaattcagaggttcagctgcagcagtctggggctgaacttgtgaggccaggggccttagtcaagttgtcctgcacagcttctgacttcaacattaaagacttctatctacactggatgaggcagcggcctgaacagggcctggactggattggaaggattgatcctgagaatggtgatactttatatgacccgaagttccaggacaaggccactcttacaacagacacatcctccaacacagcctacctgcagctcagcggcctgacatctgagaccactgccgtctattactgttctagagaggcggattatttccacgatggtacctcctactggtacttcgatgtctggggcgcagggaccacaatcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 133 - protein, 214 aa, Mus musculus
DIQMTQITSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 134 - DNA, 645 bp, Mus musculus
gatatccagatgacacagattacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 135 - protein, 234 aa, Mus musculus
MMSSAQFLGLLLLCFQGTRCDIQMTQITSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 136 - DNA, 705 bp, Mus musculus
atgatgtcctctgctcagttccttggtctcctgttgctctgttttcaaggtaccagatgtgatatccagatgacacagattacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 137 - protein, 447 aa, Mus musculus
EVQLQQSGPELMKPGASVKMSCKASGYTFTDYNMHWVKQNQGKTLEWIGEINPNSGGAGYNQKFKGKATLTVDKSSTTAYMELRSLTSEDSAVYYCARLGYDDIYDDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 138 - DNA, 1344 bp, Mus musculus
gaggtccaactgcaacagtctggacctgaactaatgaagcctggggcttcagtgaagatgtcctgcaaggcttctggatatacattcactgactacaacatgcactgggtgaagcagaaccaaggaaagaccctagagtggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 139 - protein, 466 aa, Mus musculus
MGWSWTFLFLLSGTAGVLSEVQLQQSGPELMKPGASVKMSCKASGYTFTDYNMHWVKQNQGKTLEWIGEINPNSGGAGYNQKFKGKATLTVDKSSTTAYMELRSLTSEDSAVYYCARLGYDDIYDDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 140 - DNA, 1401 bp, Mus musculus
atgggatggagctggacctttctcttcctcctgtcaggaactgcaggtgtcctctctgaggtccaactgcaacagtctggacctgaactaatgaagcctggggcttcagtgaagatgtcctgcaaggcttctggatatacattcactgactacaacatgcactgggtgaagcagaaccaaggaaagaccctagagtggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 141 - protein, 214 aa, Artificial Sequence
  Synthetic Polypeptide
  MISC_FEATURE: Humanized Antibody Sequence
DIQMTQSPSSLSASVGDRVTITCRASQDISNYLNWYQQKPGKAPKLLIYYTSRLLSGVPSRFSGSGSGTDFTLTISSLQPEDFATYYCQQGDTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 142 - DNA, 642 bp, Artificial Sequence
  Synthetic Polynucleotide
  misc_feature: Humanized Antibody Sequence
gacatccagatgacccagtctccatcctccctctccgcatccgtaggcgaccgcgtaaccataacatgtagagcatctcaagatatttccaactatttgaattggtaccaacaaaaacccggcaaagcacctaaactcctcatttactatacatcaagactcctctccggcgttccatcacgattctcaggctccggctccggcacagatttcacactcactatttcctccctccaaccagaagattttgcaacctattactgtcaacaaggcgatacactcccatacacattcggcggcggcacaaaagttgaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 143 - protein, 236 aa, Artificial Sequence
  Synthetic Polypeptide
  MISC_FEATURE: Humanized Antibody Sequence
MDMRVPAQLLGLLLLWLRGARCDIQMTQSPSSLSASVGDRVTITCRASQDISNYLNWYQQKPGKAPKLLIYYTSRLLSGVPSRFSGSGSGTDFTLTISSLQPEDFATYYCQQGDTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 144 - DNA, 708 bp, Artificial Sequence
  Synthetic Polynucleotide
  misc_feature: Humanized Antibody Sequence
atggacatgagggtccccgctcagctcctggggctcctgctactctggctccgaggtgccagatgtgacatccagatgacccagtctccatcctccctctccgcatccgtaggcgaccgcgtaaccataacatgtagagcatctcaagatatttccaactatttgaattggtaccaacaaaaacccggcaaagcacctaaactcctcatttactatacatcaagactcctctccggcgttccatcacgattctcaggctccggctccggcacagatttcacactcactatttcctccctccaaccagaagattttgcaacctattactgtcaacaaggcgatacactcccatacacattcggcggcggcacaaaagttgaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 145 - protein, 449 aa, Artificial Sequence
  Synthetic Polypeptide
  MISC_FEATURE: Humanized Antibody Sequence
EVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 146 - DNA, 1347 bp, Artificial Sequence
  Synthetic Polynucleotide
  misc_feature: Humanized Antibody Sequence
gaggtgcagctggtgcagagcggcgccgaggtaaaaaaaccaggagcaagcgttaaagtttcttgtaaagcaagcggatatacatttacagattacaacatgcattgggtaagacaagcgccaggacaaggattggaatggatgggcgaaattaaccctaatagtggaggagcaggctacaatcaaaaattcaaagggagagttacaatgacaacagacacaagcacttcaacagcatatatggaactgcgatcacttagaagcgacgatacagctgtatactattgcgcacgacttgggtatgatgatatatatgatgactggtatttcgatgtttggggccagggaacaacagttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 147 - protein, 468 aa, Artificial Sequence
  Synthetic Polypeptide
  MISC_FEATURE: Humanized Antibody Sequence
MDWTWRILFLVAAATGAHSEVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 148 - DNA, 1404 bp, Mus musculus
atggactggacctggaggatcctcttcttggtggcagcagccacaggagcccactccgaggtgcagctggtgcagagcggcgccgaggtaaaaaaaccaggagcaagcgttaaagtttcttgtaaagcaagcggatatacatttacagattacaacatgcattgggtaagacaagcgccaggacaaggattggaatggatgggcgaaattaaccctaatagtggaggagcaggctacaatcaaaaattcaaagggagagttacaatgacaacagacacaagcacttcaacagcatatatggaactgcgatcacttagaagcgacgatacagctgtatactattgcgcacgacttgggtatgatgatatatatgatgactggtatttcgatgtttggggccagggaacaacagttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 149 - protein, 214 aa, Mus musculus
DIQMTQTTSSLSASLGDRVTISCRASQDISNYLNWFQQKPDGTLKLLIFYTSRLHSGVPSRFSGSGSGTDYSLTISNLEQEDIATYFCQQGDTLPYTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 150 - DNA, 645 bp, Mus musculus
gatatccagatgacacagactacatcctccctgtctgcctctctgggagacagagtcaccatcagttgcagggcaagtcaggacattagcaattatttaaactggtttcagcagaaaccagatggaactcttaaactcctgatcttctacacatcaagattacactcaggagttccatcaaggttcagtggcagtgggtctggaacagattattctctcaccattagcaacctggagcaagaagatattgccacttacttttgccaacagggtgatacgcttccgtacacgttcgggggggggaccaagctggaaataagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 151 - protein, 234 aa, Mus musculus
MMSSAQFLGLLLLCFQGTRCDIQMTQTTSSLSASLGDRVTISCRASQDISNYLNWFQQKPDGTLKLLIFYTSRLHSGVPSRFSGSGSGTDYSLTISNLEQEDIATYFCQQGDTLPYTFGGGTKLEIRRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 152 - DNA, 705 bp, Mus musculus
atgatgtcctctgctcagttccttggtctcctgttgctctgttttcaaggtaccagatgtgatatccagatgacacagactacatcctccctgtctgcctctctgggagacagagtcaccatcagttgcagggcaagtcaggacattagcaattatttaaactggtttcagcagaaaccagatggaactcttaaactcctgatcttctacacatcaagattacactcaggagttccatcaaggttcagtggcagtgggtctggaacagattattctctcaccattagcaacctggagcaagaagatattgccacttacttttgccaacagggtgatacgcttccgtacacgttcgggggggggaccaagctggaaataagacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 153 - protein, 447 aa, Mus musculus
EVQLQQSGPELMKPGASVKMSCKASGYTFTDYNMHWVKQNQGKSLEWIGEINPNSGGSGYNQKFKGKATLTVDKSSSTAYMELRSLTSEDSAVYYCARLVYDGSYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 154 - DNA, 1344 bp, Mus musculus
gaggtccagctgcaacagtctggacctgaactaatgaagcctggggcttcagtgaagatgtcctgcaaggcttctggatacacattcactgactacaacatgcactgggtgaaacagaaccaaggaaagagcctagagtggataggagaaattaatcctaacagtggtggtagtggctacaaccaaaagttcaaaggcaaggccacattgactgtagacaagtcttccagcacagcctacatggagctccgcagcctgacatctgaggactctgcagtctattactgtgcaagattggtctacgatggcagctacgaggactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 155 - protein, 466 aa, Mus musculus
MGWSWTFLFLLSGTAGVLSEVQLQQSGPELMKPGASVKMSCKASGYTFTDYNMHWVKQNQGKSLEWIGEINPNSGGSGYNQKFKGKATLTVDKSSSTAYMELRSLTSEDSAVYYCARLVYDGSYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 156 - DNA, 1401 bp, Mus musculus
atgggatggagctggacctttctcttcctcctgtcaggaactgcaggtgtcctctctgaggtccagctgcaacagtctggacctgaactaatgaagcctggggcttcagtgaagatgtcctgcaaggcttctggatacacattcactgactacaacatgcactgggtgaaacagaaccaaggaaagagcctagagtggataggagaaattaatcctaacagtggtggtagtggctacaaccaaaagttcaaaggcaaggccacattgactgtagacaagtcttccagcacagcctacatggagctccgcagcctgacatctgaggactctgcagtctattactgtgcaagattggtctacgatggcagctacgaggactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 157 - protein, 214 aa, Mus musculus
DIQMTQTTSSLSASLGDRVTICCRASQVITNYLYWYQQKPDGTFKLLIYYTSRLHSGVPSRFSGSGSGTDYSLTISNLEQEDIATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 158 - DNA, 642 bp, Mus musculus
gatatccagatgacacagactacatcctccctgtctgcctctctgggagacagagtcaccatctgttgcagggcaagtcaggtcattaccaattatttatactggtatcagcagaaaccagatggaacttttaaactcctgatctactacacatcaagattacactcaggagtcccatcaaggttcagtggcagtgggtctggaacagattattctctcaccattagcaacctggaacaggaagatattgccacttacttttgccaacagggtgatacgcttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 159 - protein, 234 aa, Mus musculus
MMSSAQFLGLLLLCFQGTRCDIQMTQTTSSLSASLGDRVTICCRASQVITNYLYWYQQKPDGTFKLLIYYTSRLHSGVPSRFSGSGSGTDYSLTISNLEQEDIATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 160 - DNA, 702 bp, Mus musculus
atgatgtcctctgctcagttccttggtctcctgttgctctgttttcaaggtaccagatgtgatatccagatgacacagactacatcctccctgtctgcctctctgggagacagagtcaccatctgttgcagggcaagtcaggtcattaccaattatttatactggtatcagcagaaaccagatggaacttttaaactcctgatctactacacatcaagattacactcaggagtcccatcaaggttcagtggcagtgggtctggaacagattattctctcaccattagcaacctggaacaggaagatattgccacttacttttgccaacagggtgatacgcttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 161 - protein, 447 aa, Mus musculus
EVQLQQSGPELMKPGASVKMSCKASGYTFTDYNMHWMKQNQGKSLEWIGEINPNSGGAGYNQQFKGKATLTVDKSSRTAYMELRSLTSEDSAVYYCARLGYVGNYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 162 - DNA, 1341 bp, Mus musculus
gaggtccagctgcaacagtctggacctgaactaatgaagcctggggcttcagtgaagatgtcctgcaaggcttctggatacacattcactgactacaacatgcactggatgaagcagaaccaaggaaagagcctagaatggataggagaaattaatcctaacagtggtggtgctggctacaaccagcagttcaaaggcaaggccacattgactgtagacaagtcctccaggacagcctacatggagctccgcagcctgacatctgaggactctgcagtctattactgtgcaagattgggctacgttggtaattacgaggactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 163 - protein, 466 aa, Mus musculus
MGWSWTFLFLLSGTAGVLSEVQLQQSGPELMKPGASVKMSCKASGYTFTDYNMHWMKQNQGKSLEWIGEINPNSGGAGYNQQFKGKATLTVDKSSRTAYMELRSLTSEDSAVYYCARLGYVGNYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 164 - DNA, 1398 bp, Mus musculus
atgggatggagctggacctttctcttcctcctgtcaggaactgcaggtgtcctctctgaggtccagctgcaacagtctggacctgaactaatgaagcctggggcttcagtgaagatgtcctgcaaggcttctggatacacattcactgactacaacatgcactggatgaagcagaaccaaggaaagagcctagaatggataggagaaattaatcctaacagtggtggtgctggctacaaccagcagttcaaaggcaaggccacattgactgtagacaagtcctccaggacagcctacatggagctccgcagcctgacatctgaggactctgcagtctattactgtgcaagattgggctacgttggtaattacgaggactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 165 - protein, 214 aa, Mus musculus
DIQMTQTTSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 166 - DNA, 645 bp, Mus musculus
gatatccagatgacacagactacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaaactggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 167 - protein, 234 aa, Mus musculus
MMSSAQFLGLLLLCFQGTRCDIQMTQTTSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 168 - DNA, 705 bp, Mus musculus
atgatgtcctctgctcagttccttggtctcctgttgctctgttttcaaggtaccagatgtgatatccagatgacacagactacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaaactggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 169 - protein, 447 aa, Mus musculus
EVQLQQSGPELMKPGASVKMSCKASGYTFTDYNMHWVKQNQGKTLDWIGEINPNSGGAGYNQKFKGKATLTVDKSSTTAYMELRSLTSEDSAVYYCARLGYDDIYDDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 170 - DNA, 1344 bp, Mus musculus
gaggtccaactgcaacagtctggacctgaactaatgaagcctggggcttcagtgaagatgtcctgcaaggcttctggatatacattcactgactacaacatgcactgggtgaagcagaaccaaggaaagaccctagactggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 171 - protein, 466 aa, Mus musculus
MGWSWTFLFLLSGTAGVLSEVQLQQSGPELMKPGASVKMSCKASGYTFTDYNMHWVKQNQGKTLDWIGEINPNSGGAGYNQKFKGKATLTVDKSSTTAYMELRSLTSEDSAVYYCARLGYDDIYDDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 172 - DNA, 1401 bp, Mus musculus
atgggatggagctggacctttctcttcctcctgtcaggaactgcaggtgtcctctctgaggtccaactgcaacagtctggacctgaactaatgaagcctggggcttcagtgaagatgtcctgcaaggcttctggatatacattcactgactacaacatgcactgggtgaagcagaaccaaggaaagaccctagactggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 173 - protein, 214 aa, Mus musculus
DIQMTQITSSLSASLGDRVSISCRASQDISNYLNWYQQKPDGTFKLLIFYTSRLFSGVPSRFSGSGSGTDYSLTIYNLEQEDFATYFCQQGDTLPYTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 174 - DNA, 642 bp, Mus musculus
gatatccagatgacacagattacatcctccctgtctgcctctctgggagacagggtctccatcagttgcagggcaagtcaagacattagcaattatttaaattggtatcagcagaaaccagatggaacttttaaactccttatcttctacacatcaagattattttcaggagtcccatcaaggttcagtggcagtgggtctggaacagattattctctcaccatttacaacctggagcaagaagattttgccacttacttttgccaacagggagatacgcttccgtacactttcggaggggggaccaaggtggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 175 - protein, 234 aa, Mus musculus
MMSSAQFLGLLLLCFQGTRCDIQMTQITSSLSASLGDRVSISCRASQDISNYLNWYQQKPDGTFKLLIFYTSRLFSGVPSRFSGSGSGTDYSLTIYNLEQEDFATYFCQQGDTLPYTFGGGTKVEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 176 - DNA, 702 bp, Mus musculus
atgatgtcctctgctcagttccttggtctcctgttgctctgttttcaaggtaccagatgtgatatccagatgacacagattacatcctccctgtctgcctctctgggagacagggtctccatcagttgcagggcaagtcaagacattagcaattatttaaattggtatcagcagaaaccagatggaacttttaaactccttatcttctacacatcaagattattttcaggagtcccatcaaggttcagtggcagtgggtctggaacagattattctctcaccatttacaacctggagcaagaagattttgccacttacttttgccaacagggagatacgcttccgtacactttcggaggggggaccaaggtggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgt

SEQ ID NO: 177 - protein, 450 aa, Mus musculus
EVQLQQSGPELMKPGTSVKMSCKASGYTFTDYNMHWVKQTQGKTLEWIGEINPNSGGAGYNQKFKGKATLTVDKSSTTAYMELRSLTSEDSAVYYCAKLGYDDIYDDWYFDVWGAGTTVTVSSAKTTAPSVYPLAPVCGDTTGSSVTLGCLVKGYFPEPVTLTWNSGSLSSDVHTFPALLQSGLYTLSSSVTVTTWPSQTITCNVAHPASSTKVDKKIEPRGSPTHKPCPPCPAPNLLGGPSVFIFPPKIKDVLMISLSPMVTCVVVDVSEDDPDVHVSWFVNNVEVHTAQTQTHREDYNSTIRVVSALPIQHQDWMSGKEFKCKVNNKALPAPIERTISKPKGPVRAPQVYVLPPPEEEMTKKQVTLTCMITDFMPEDIYVEWTNNGQTELNYKNTEPVLDSDGSYFMYSKLRVEKKNWVERNSYSCSVVHEGLHNHHTTKSFSRTPGK

SEQ ID NO: 178 - DNA, 1350 bp, Mus musculus
gaggtccaactgcaacagtctggacctgaactaatgaagcctgggacttcagtgaagatgtcctgcaaggcttctggatatacattcactgactacaacatgcactgggtgaagcagacccaaggaaagaccctagagtggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaaaattgggctacgatgatatctacgacgactggtatttcgatgtctggggcgcagggaccacggtcaccgtctcctcagccaaaacaacagccccatcggtctatccactggcccctgtgtgtggagatacaactggctcctcggtgactctaggatgcctggtcaagggttatttccctgagccagtgaccttgacctggaactctggatccctgtccagtgatgtgcacaccttcccagctctcctgcagtctggcctctacaccctcagcagctcagtgactgtaaccacctggcccagccagaccatcacctgcaatgtggcccacccggcaagcagcaccaaagtggacaagaaaattgagcccagagggtccccaacacataaaccctgtcctccatgcccagctcctaacctcttgggtggaccatccgtcttcatcttccctccaaagatcaaggatgtactcatgatctccctgagccccatggtcacgtgtgtggtggtggatgtgagcgaggatgacccagatgtccatgtcagctggttcgtgaacaacgtggaagtacacacagctcagacacaaacccatagagaggattacaacagtactatccgggtggtcagtgccctccccatccagcaccaggactggatgagtggcaaggagttcaaatgcaaggtcaacaacaaagccctcccagcgcccatcgagagaaccatctcaaaacccaaagggccagtaagagctccacaggtatatgtcttgcctccaccagaagaagagatgactaagaaacaggtcactctgacctgcatgatcacagacttcatgcctgaagacatttacgtggagtggaccaacaacgggcaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 179 - protein, 469 aa, Mus musculus
MGWSWTFLFLLSGTAGVLSEVQLQQSGPELMKPGTSVKMSCKASGYTFTDYNMHWVKQTQGKTLEWIGEINPNSGGAGYNQKFKGKATLTVDKSSTTAYMELRSLTSEDSAVYYCAKLGYDDIYDDWYFDVWGAGTTVTVSSAKTTAPSVYPLAPVCGDTTGSSVTLGCLVKGYFPEPVTLTWNSGSLSSDVHTFPALLQSGLYTLSSSVTVTTWPSQTITCNVAHPASSTKVDKKIEPRGSPTHKPCPPCPAPNLLGGPSVFIFPPKIKDVLMISLSPMVTCVVVDVSEDDPDVHVSWFVNNVEVHTAQTQTHREDYNSTIRVVSALPIQHQDWMSGKEFKCKVNNKALPAPIERTISKPKGPVRAPQVYVLPPPEEEMTKKQVTLTCMITDFMPEDIYVEWTNNGQTELNYKNTEPVLDSDGSYFMYSKLRVEKKNWVERNSYSCSVVHEGLHNHHTTKSFSRTPGK

SEQ ID NO: 180 - DNA, 1407 bp, Mus musculus
atgggatggagctggacctttctcttcctcctgtcaggaactgcaggtgtcctctctgaggtccaactgcaacagtctggacctgaactaatgaagcctgggacttcagtgaagatgtcctgcaaggcttctggatatacattcactgactacaacatgcactgggtgaagcagacccaaggaaagaccctagagtggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaaaattgggctacgatgatatctacgacgactggtatttcgatgtctggggcgcagggaccacggtcaccgtctcctcagccaaaacaacagccccatcggtctatccactggcccctgtgtgtggagatacaactggctcctcggtgactctaggatgcctggtcaagggttatttccctgagccagtgaccttgacctggaactctggatccctgtccagtgatgtgcacaccttcccagctctcctgcagtctggcctctacaccctcagcagctcagtgactgtaaccacctggcccagccagaccatcacctgcaatgtggcccacccggcaagcagcaccaaagtggacaagaaaattgagcccagagggtccccaacacataaaccctgtcctccatgcccagctcctaacctcttgggtggaccatccgtcttcatcttccctccaaagatcaaggatgtactcatgatctccctgagccccatggtcacgtgtgtggtggtggatgtgagcgaggatgacccagatgtccatgtcagctggttcgtgaacaacgtggaagtacacacagctcagacacaaacccatagagaggattacaacagtactatccgggtggtcagtgccctccccatccagcaccaggactggatgagtggcaaggagttcaaatgcaaggtcaacaacaaagccctcccagcgcccatcgagagaaccatctcaaaacccaaagggccagtaagagctccacaggtatatgtcttgcctccaccagaagaagagatgactaagaaacaggtcactctgacctgcatgatcacagacttcatgcctgaagacatttacgtggagtggaccaacaacgggcaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaa

SEQ ID NO: 181 - protein, 214 aa, Mus musculus
DIQMTQTTSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPLSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 182 - DNA, 645 bp, Mus musculus
gatatccagatgacacagactacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaaactggaaataaaacgggctgatgctgcaccaactgtatccatcttcccactatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 183 - protein, 234 aa, Mus musculus
MMSSAQFLGLLLLCFQGTRCDIQMTQTTSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIKRADAAPTVSIFPLSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 184 - DNA, 705 bp, Mus musculus
atgatgtcctctgctcagttccttggtctcctgttgctctgttttcaaggtaccagatgtgatatccagatgacacagactacatcctccctgtctgcctctctgggagacagggtctccatcagttgcagggcaagtcaagacattagcaattatttaaactggtatcagcagaaaccagatggaacttttaaactccttatcttctacacatcaagattactctcaggagtcccatcaaggttcagtggcagtgggtctggaacagattattctctcaccatttacaacctggagcaagaagattttgccacttacttttgccaacagggagatacgcttccgtacactttcggaggggggaccaaactggaaataaaacgggctgatgctgcaccaactgtatccatcttcccactatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 185 - protein, 447 aa, Mus musculus; identical to SEQ ID NO: 137

SEQ ID NO: 186 - DNA, 1344 bp, Mus musculus
gaggtccaactgcaacagtctggacctgaactaatgaagcctggggcttcagtgaagatgtcctgcaaggcttctggatatacattcactgactacaacatgcactgggtgaagcagaaccaaggaaagaccctagaatggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 187 - protein, 466 aa, Mus musculus; identical to SEQ ID NO: 139

SEQ ID NO: 188 - DNA, 1401 bp, Mus musculus
atgggatggagctggacctttctcttcctcctgtcaggaactgcaggtgtcctctctgaggtccaactgcaacagtctggacctgaactaatgaagcctggggcttcagtgaagatgtcctgcaaggcttctggatatacattcactgactacaacatgcactgggtgaagcagaaccaaggaaagaccctagaatggataggagaaattaatcctaacagtggtggtgctggctacaaccagaagttcaagggcaaggccacattgactgtagacaagtcctccaccacagcctacatggagctccgcagcctgacatctgaggactctgcagtctattactgtgcaagattgggctacgatgatatctacgacgactggtacttcgatgtctggggcgcagggaccacggtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 189 - protein, 213 aa, Mus musculus
QIVLSQSPAFLSVSPGDKVTMTCRASSSISYIHWFQQKPGSSPRSWIYATSNLASGVPGRFSGSGSGTSYSLTISRVEAEDAATYYCQQWSSDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 190 - DNA, 642 bp, Mus musculus
caaattgttctctcccagtctccagcattcctgtctgtatctccaggggataaggtcacaatgacttgcagggccagctcaagtataagttacatacactggtttcagcagaagccaggatcctcccccagatcctggatttatgccacatccaacctggcttctggagtccctggtcgcttcagtggcagtgggtctgggacctcttactctctcacaatcagcagagtggaggctgaggatgctgccacttattactgccagcagtggagtagtgacccactcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 191 - protein, 235 aa, Mus musculus
MDFQVQIFSFLLISASVIMSRGQIVLSQSPAFLSVSPGDKVTMTCRASSSISYIHWFQQKPGSSPRSWIYATSNLASGVPGRFSGSGSGTSYSLTISRVEAEDAATYYCQQWSSDPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 192 - DNA, 708 bp, Mus musculus
atggattttcaagtgcagattttcagcttcctgctaatcagtgcttcagtcataatgtccagaggacaaattgttctctcccagtctccagcattcctgtctgtatctccaggggataaggtcacaatgacttgcagggccagctcaagtataagttacatacactggtttcagcagaagccaggatcctcccccagatcctggatttatgccacatccaacctggcttctggagtccctggtcgcttcagtggcagtgggtctgggacctcttactctctcacaatcagcagagtggaggctgaggatgctgccacttattactgccagcagtggagtagtgacccactcacgttcggtgctgggaccaagctggagctgaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 193 - protein, 445 aa, Mus musculus
EVQLQQSGADLVQPGASVKVSCTASGFDIKDYYIHWMKQRPDQGLEWIGRVDPDNGETEFAPKFPGKATFTTDTSSNTAYLQLRGLTSEDTAIYYCGREDYDGTYTWFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 194 - DNA, 1338 bp, Mus musculus
gaagttcagctgcaacagtctggggcagaccttgtgcagccaggggcctcagtcaaggtgtcctgcacagcttctggcttcgacattaaggactactatatacactggatgaaacagaggcctgaccagggcctggagtggattggaagggttgatcctgacaatggtgagactgaatttgccccgaagttcccgggcaaggccacttttacaacagacacatcctccaacacagcctacctacaactcagaggcctgacatctgaggacactgccatctattactgtgggagagaagactacgatggtacctacacctggtttccttattggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 195 - protein, 464 aa, Mus musculus
MKCSWVIFFLMAVVTGVNSEVQLQQSGADLVQPGASVKVSCTASGFDIKDYYIHWMKQRPDQGLEWIGRVDPDNGETEFAPKFPGKATFTTDTSSNTAYLQLRGLTSEDTAIYYCGREDYDGTYTWFPYWGQGTLVTVSAAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 196 - DNA, 1395 bp, Mus musculus
atgaaatgcagctgggtcatcttcttcctgatggcagtggttacaggggtcaattcagaagttcagctgcaacagtctggggcagaccttgtgcagccaggggcctcagtcaaggtgtcctgcacagcttctggcttcgacattaaggactactatatacactggatgaaacagaggcctgaccagggcctggagtggattggaagggttgatcctgacaatggtgagactgaatttgccccgaagttcccgggcaaggccacttttacaacagacacatcctccaacacagcctacctacaactcagaggcctgacatctgaggacactgccatctattactgtgggagagaagactacgatggtacctacacctggtttccttattggggccaagggactctggtcactgtctctgcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 197 - protein, 214 aa, Mus musculus
DLQMTQTTSSLSASLGDRVTISCRASQDISNYLNWYQQKPDGTVKLLIFYTSTLQSGVPSRFSGSGSGTNYSLTITNLEQDDAATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 198 - DNA, 645 bp, Mus musculus
gatctccagatgacacagactacttcctccctgtctgcctctctgggagacagagtcaccatcagttgcagggcaagtcaggacattagcaattatttaaactggtatcagcagaaaccagatggaactgttaagctcctgatcttctacacatcaacattacagtcaggagtcccatcgaggttcagtggcagtgggtctggaacaaattattctctcaccattaccaacctggagcaagatgatgctgccacttacttttgccaacagggtgatacgcttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 199 - protein, 234 aa, Mus musculus
MMSSAQFLGLLLLCFQGSRCDLQMTQTTSSLSASLGDRVTISCRASQDISNYLNWYQQKPDGTVKLLIFYTSTLQSGVPSRFSGSGSGTNYSLTITNLEQDDAATYFCQQGDTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 200 - DNA, 705 bp, Mus musculus
atgatgtcctctgctcagttccttggtctcctgttgctctgttttcaaggttccagatgtgatctccagatgacacagactacttcctccctgtctgcctctctgggagacagagtcaccatcagttgcagggcaagtcaggacattagcaattatttaaactggtatcagcagaaaccagatggaactgttaagctcctgatcttctacacatcaacattacagtcaggagtcccatcgaggttcagtggcagtgggtctggaacaaattattctctcaccattaccaacctggagcaagatgatgctgccacttacttttgccaacagggtgatacgcttccgtacacgttcggaggggggaccaagctggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 201 - protein, 447 aa, Mus musculus
EVQLQQSGPELMKPGASVKMSCKASGYTFTDYNMHWMKQNQGKSLEWIGEINPNSGGSGYNQKFKGKATLTVDKSSSTAYMELRSLTSEDSAVYYCARLGYYGNYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 202 - DNA, 1344 bp, Mus musculus
gaggtccagttgcaacagtctggacctgaactaatgaagcctggggcttcagtgaagatgtcctgcaaggcttctggatacacattcactgactacaacatgcactggatgaagcagaaccaaggaaagagcctagagtggataggagagattaatcctaacagtggtggttctggttacaaccagaagttcaaaggcaaggccacattgactgtagacaagtcctccagcacagcctacatggagctccgcagcctgacatctgaggactctgcagtctattactgtgcaagattgggctactatggtaactacgaggactggtatttcgatgtctggggcgcagggaccacggtcaccgtctcctctgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 203 - protein, 466 aa, Mus musculus
MGWSWTFLFLLSGTSGVLSEVQLQQSGPELMKPGASVKMSCKASGYTFTDYNMHWMKQNQGKSLEWIGEINPNSGGSGYNQKFKGKATLTVDKSSSTAYMELRSLTSEDSAVYYCARLGYYGNYEDWYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 204 - DNA, 1401 bp, Mus musculus
atgggatggagctggacctttctcttcctcctgtcaggaacttcgggtgtcctctctgaggtccagttgcaacagtctggacctgaactaatgaagcctggggcttcagtgaagatgtcctgcaaggcttctggatacacattcactgactacaacatgcactggatgaagcagaaccaaggaaagagcctagagtggataggagagattaatcctaacagtggtggttctggttacaaccagaagttcaaaggcaaggccacattgactgtagacaagtcctccagcacagcctacatggagctccgcagcctgacatctgaggactctgcagtctattactgtgcaagattgggctactatggtaactacgaggactggtatttcgatgtctggggcgcagggaccacggtcaccgtctcctctgccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 205 - protein, 215 aa, Mus musculus
QIVLTQSPAIMSASPGEKVTMTCRASSSVTSSYLNWYQQKPGSSPKLWIYSTSNLASGVPARFSGSGSGTSYSLTISSVEAEDAATYYCQQYDFFPSTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 206 - DNA, 645 bp, Mus musculus
cagattgttctcacccagtctccagcaatcatgtctgcatctccaggggagaaggtcaccatgacctgcagggccagctcaagtgtaacttccagttacttgaactggtaccagcagaagccaggatcttcccccaaactctggatttatagcacatccaacctggcttcaggagtcccagctcgcttcagtggcagtgggtctgggacctcttactctctcacaatcagcagtgtggaggctgaggatgctgccacttattactgccagcagtatgattttttcccatcgacgttcggtggaggcaccaagctggaaatcaagcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccatcgtcaagagcttcaacaggaatgagtgt

SEQ ID NO: 207 - protein, 237 aa, Mus musculus
MDSQVQIFSFLLISALVKMSRGQIVLTQSPAIMSASPGEKVTMTCRASSSVTSSYLNWYQQKPGSSPKLWIYSTSNLASGVPARFSGSGSGTSYSLTISSVEAEDAATYYCQQYDFFPSTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 208 - DNA, 711 bp, Mus musculus
atggattctcaagtgcagattttcagcttccttctaatcagtgccttagtcaaaatgtccagaggacagattgttctcacccagtctccagcaatcatgtctgcatctccaggggagaaggtcaccatgacctgcagggccagctcaagtgtaacttccagttacttgaactggtaccagcagaagccaggatcttcccccaaactctggatttatagcacatccaacctggcttcaggagtcccagctcgcttcagtggcagtgggtctgggacctcttactctctcacaatcagcagtgtggaggctgaggatgctgccacttattactgccagcagtatgattttttcccatcgacgttcggtggaggcaccaagctggaaatcaagcgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccatcgtcaagagcttcaacaggaatgagtgt

SEQ ID NO: 209 - protein, 445 aa, Mus musculus
EVQLQQSGPELVKPGASVKMSCKASGYTFTDYYMNWVKQSHGESLEWIGDINPYNDDTTYNHKFKGKATLTVDKSSNTAYMQLNSLTSEDSAVYYCARETAVITTNAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 210 - DNA, 1335 bp, Mus musculus
gaggtccagctgcaacaatctggacctgagctggtgaagcctggggcttcagtgaagatgtcctgtaaggcttctggatacacattcactgactactacatgaactgggtgaagcagagccatggagagagccttgagtggattggagatattaatccttacaacgatgatactacctacaaccacaagttcaagggcaaggccacattgactgtagacaaatcctccaacacagcctacatgcagctcaacagcctgacatctgaggactctgcagtctattactgtgcaagagagacggccgttattactacgaatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 211 - protein, 464 aa, Mus musculus
MGWNWIFLFLLSGTAGVYSEVQLQQSGPELVKPGASVKMSCKASGYTFTDYYMNWVKQSHGESLEWIGDINPYNDDTTYNHKFKGKATLTVDKSSNTAYMQLNSLTSEDSAVYYCARETAVITTNAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 212 - DNA, 1392 bp, Mus musculus
atgggatggaactggatctttctcttcctcttgtcaggaactgcaggtgtctactctgaggtccagctgcaacaatctggacctgagctggtgaagcctggggcttcagtgaagatgtcctgtaaggcttctggatacacattcactgactactacatgaactgggtgaagcagagccatggagagagccttgagtggattggagatattaatccttacaacgatgatactacctacaaccacaagttcaagggcaaggccacattgactgtagacaaatcctccaacacagcctacatgcagctcaacagcctgacatctgaggactctgcagtctattactgtgcaagagagacggccgttattactacgaatgctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaa

SEQ ID NO: 213 - protein, 215 aa, Artificial Sequence
  Synthetic Polypeptide
  MISC_FEATURE: Humanized Antibody Sequence
DIQLTQSPSFLSASVGDRVTITCRASSSVTSSYLNWYQQKPGKAPKLLIYSTSNLASGVPSRFSGSGSGTEFTLTISSLQPEDFATYYCQQYDFFPSTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 214 - DNA, 645 bp, Artificial Sequence
  Synthetic Polynucleotide
  misc_feature: Humanized Antibody Sequence
gacatccagctgacccagagccccagcttcctttccgcatccgttggtgaccgagtaacaatcacatgccgcgcctcatcttcagttacatcttcttatcttaattggtatcaacaaaaaccaggaaaagcacctaaacttcttatatactctacatctaatctcgcatcaggagttccctctcgattttcaggatctggatcaggcacagaatttacacttactatatcatcactccaaccagaagacttcgccacttattactgccaacaatacgatttttttccaagcacattcggaggaggtacaaaagtagaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 215 - protein, 237 aa, Artificial Sequence
  Synthetic Polypeptide
  MISC_FEATURE: Humanized Antibody Sequence
MDMRVPAQLLGLLLLWLPGARCDIQLTQSPSFLSASVGDRVTITCRASSSVTSSYLNWYQQKPGKAPKLLIYSTSNLASGVPSRFSGSGSGTEFTLTISSLQPEDFATYYCQQYDFFPSTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 216 - DNA, 711 bp, Artificial Sequence
  Synthetic Polynucleotide
  misc_feature: Humanized Antibody Sequence
atggacatgagggtccccgctcagctcctggggctcctgctactctggctcccaggtgccagatgtgacatccagctgacccagagccccagcttcctttccgcatccgttggtgaccgagtaacaatcacatgccgcgcctcatcttcagttacatcttcttatcttaattggtatcaacaaaaaccaggaaaagcacctaaacttcttatatactctacatctaatctcgcatcaggagttccctctcgattttcaggatctggatcaggcacagaatttacacttactatatcatcactccaaccagaagacttcgccacttattactgccaacaatacgatttttttccaagcacattcggaggaggtacaaaagtagaaatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 217 - protein, 447 aa, Artificial Sequence
  Synthetic Polypeptide
  MISC_FEATURE: Humanized Antibody Sequence
EVQLVQSGAEVKKPGASVKVSCKASGYTFTDYYMNWVRQAPGQRLEWMGDINPYNDDTTYNHKFKGRVTITRDTSASTAYMELSSLRSEDTAVYYCARETAVITTNAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 218 - DNA, 1341 bp, Artificial Sequence
  Synthetic Polynucleotide
  misc_feature: Humanized Antibody Sequence
gaggtgcagctggtgcagagcggcgccgaggtcaagaaacctggagcaagcgtaaaggttagttgcaaagcatctggatacacatttaccgactactacatgaattgggtacgacaagcccctggacaaagacttgaatggatgggagacattaacccttataacgacgacactacatacaatcataaatttaaaggaagagttacaattacaagagatacatccgcatcaaccgcctatatggaactttcctcattgagatctgaagacactgctgtttattactgtgcaagagaaactgccgttattactactaacgctatggattactggggtcaaggaaccactgttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 219 - protein, 466 aa, Artificial Sequence
  Synthetic Polypeptide
  MISC_FEATURE: Humanized Antibody Sequence
MDWTWRILFLVAAATGAHSEVQLVQSGAEVKKPGASVKVSCKASGYTFTDYYMNWVRQAPGQRLEWMGDINPYNDDTTYNHKFKGRVTITRDTSASTAYMELSSLRSEDTAVYYCARETAVITTNAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 220 - DNA, 1398 bp, Artificial Sequence
  Synthetic Polynucleotide
  misc_feature: Humanized Antibody Sequence
atggactggacctggaggatcctcttcttggtggcagcagccacaggagcccactccgaggtgcagctggtgcagagcggcgccgaggtcaagaaacctggagcaagcgtaaaggttagttgcaaagcatctggatacacatttaccgactactacatgaattgggtacgacaagcccctggacaaagacttgaatggatgggagacattaacccttataacgacgacactacatacaatcataaatttaaaggaagagttacaattacaagagatacatccgcatcaaccgcctatatggaactttcctcattgagatctgaagacactgctgtttattactgtgcaagagaaactgccgttattactactaacgctatggattactggggtcaaggaaccactgttaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 221 - protein, 215 aa, Artificial Sequence
  Synthetic Polypeptide
  MISC_FEATURE: Humanized Antibody Sequence
DIQMTQSPSSLSASVGDRVTITCSVSSTISSNHLHWFQQKPGKAPKSLIYGTSNLASGVPSRFSGSGSGTDFTLTISSLQPEDFATYYCQQWSSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 222 - DNA, 645 bp, Artificial Sequence
  Synthetic Polynucleotide
  misc_feature: Humanized Antibody Sequence
gacatccagatgacccagtctccatcctccctctcagcatccgtaggcgatagagttacaataacatgcagcgtatcatcaactatatcatcaaatcatcttcattggttccaacagaaacccggcaaagcacctaaatcacttatatacggcacatcaaatctcgcatcaggcgttccttcaagattttcaggctctggctcaggcaccgactttactcttacaatatcctccctccaacccgaagacttcgcaacctattactgtcaacaatggtcctcatatccactcacatttggcggcggcacaaaagtagaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 223 - protein, 237 aa, Artificial Sequence
  Synthetic Polypeptide
  MISC_FEATURE: Humanized Antibody Sequence
MDMRVPAQLLGLLLLWLRGARCDIQMTQSPSSLSASVGDRVTITCSVSSTISSNHLHWFQQKPGKAPKSLIYGTSNLASGVPSRFSGSGSGTDFTLTISSLQPEDFATYYCQQWSSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 224 - DNA, 711 bp, Artificial Sequence
  Synthetic Polynucleotide
  misc_feature: Humanized Antibody Sequence
atggacatgagggtccccgctcagctcctggggctcctgctactctggctccgaggtgccagatgtgacatccagatgacccagtctccatcctccctctcagcatccgtaggcgatagagttacaataacatgcagcgtatcatcaactatatcatcaaatcatcttcattggttccaacagaaacccggcaaagcacctaaatcacttatatacggcacatcaaatctcgcatcaggcgttccttcaagattttcaggctctggctcaggcaccgactttactcttacaatatcctccctccaacccgaagacttcgcaacctattactgtcaacaatggtcctcatatccactcacatttggcggcggcacaaaagtagaaattaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 225 - protein, 451 aa, Artificial Sequence
  Synthetic Polypeptide
  MISC_FEATURE: Humanized Antibody Sequence
EVQLVQSGAEVKKPGASVKVSCKASDFNIKDFYLHWVRQAPGQGLEWIGRIDPENGDTLYDPKFQDKVTMTTDTSTSTAYMELRSLRSDDTAVYYCAREADYFHDGTSYWYFDVWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 226 - DNA, 1353 bp, Artificial Sequence
  Synthetic Polynucleotide
gaggtgcagctggtgcagtctggggctgaggtgaagaagcctggggcctcagtgaaggtctcctgcaaggcttctgacttcaacattaaagacttctatctacactgggtgcgacaggcccctggacaagggcttgagtggattggaaggattgatcctgagaatggtgatactttatatgacccgaagttccaggacaaggtcaccatgaccacagacacgtccaccagcacagcctacatggagctgaggagcctgagatctgacgacacggccgtgtattactgtgcgagagaggcggattatttccacgatggtacctcctactggtacttcgatgtctggggccgtggcaccctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 227 - protein, 470 aa, Artificial Sequence
  Synthetic Polypeptide
  MISC_FEATURE: Humanized Antibody Sequence
MDWTWRILFLVAAATGAHSEVQLVQSGAEVKKPGASVKVSCKASDFNIKDFYLHWVRQAPGQGLEWIGRIDPENGDTLYDPKFQDKVTMTTDTSTSTAYMELRSLRSDDTAVYYCAREADYFHDGTSYWYFDVWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 228 - DNA, 1410 bp, Artificial Sequence
  Synthetic Polynucleotide
  misc_feature: Humanized Antibody Sequence
atggactggacctggaggatcctcttcttggtggcagcagccacaggagcccactccgaggtgcagctggtgcagtctggggctgaggtgaagaagcctggggcctcagtgaaggtctcctgcaaggcttctgacttcaacattaaagacttctatctacactgggtgcgacaggcccctggacaagggcttgagtggattggaaggattgatcctgagaatggtgatactttatatgacccgaagttccaggacaaggtcaccatgaccacagacacgtccaccagcacagcctacatggagctgaggagcctgagatctgacgacacggccgtgtattactgtgcgagagaggcggattatttccacgatggtacctcctactggtacttcgatgtctggggccgtggcaccctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 229 - protein, 213 aa, Artificial Sequence
  Synthetic Polypeptide
  MISC_FEATURE: Humanized Antibody Sequence
DIQLTQSPSFLSASVGDRVTITCRASSSISYIHWYQQKPGKAPKLLIYATSNLASGVPSRFSGSGSGTEFTLTISSLQPEDFATYYCQQWSSDPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 230 - DNA, 639 bp, Artificial Sequence
  Synthetic Polynucleotide
  misc_feature: Humanized Antibody Sequence
gacatccagttgacccagtctccatccttcctgtctgcatctgtaggagacagagtcaccatcacttgcagggccagctcaagtataagttacatacactggtatcagcaaaaaccagggaaagcccctaagctcctgatctatgccacatccaacctggcttctggggtcccatcaaggttcagcggcagtggatctgggacagaattcactctcacaatcagcagcctgcagcctgaagattttgcaacttattactgtcagcagtggagtagtgacccactcacgttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 231 - protein, 235 aa, Artificial Sequence
  Synthetic Polypeptide
  MISC_FEATURE: Humanized Antibody Sequence
MDMRVPAQLLGLLLLWLPGARCDIQLTQSPSFLSASVGDRVTITCRASSSISYIHWYQQKPGKAPKLLIYATSNLASGVPSRFSGSGSGTEFTLTISSLQPEDFATYYCQQWSSDPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 232 - DNA, 705 bp, Artificial Sequence
  Synthetic Polynucleotide
  misc_feature: Humanized Antibody Sequence
atggacatgagggtccccgctcagctcctggggctcctgctgctctggctcccaggtgccagatgtgacatccagttgacccagtctccatccttcctgtctgcatctgtaggagacagagtcaccatcacttgcagggccagctcaagtataagttacatacactggtatcagcaaaaaccagggaaagcccctaagctcctgatctatgccacatccaacctggcttctggggtcccatcaaggttcagcggcagtggatctgggacagaattcactctcacaatcagcagcctgcagcctgaagattttgcaacttattactgtcagcagtggagtagtgacccactcacgttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 233 - protein, 447 aa, Artificial Sequence
  Synthetic Polypeptide
  MISC_FEATURE: Humanized Antibody Sequence
EVQLVQSGAEVKKPGASVKVSCKASGFDIKDYYIHWVRQAPGQGLEWIGRVDPDNGETEFAPKFPGKVTMTTDTSISTAYMELSRLRSDDTAVYYCAREDYDGTYTWFPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 234 - DNA, 1341 bp, Artificial Sequence
  Synthetic Polynucleotide
  misc_feature: Humanized Antibody Sequence
gaggtgcagctggtgcagtctggggctgaggtgaagaagcctggggcctcagtgaaggtctcctgcaaggcttctggattcgacattaaggactactatatacactgggtgcgacaggcccctggacaagggcttgagtggatcggaagggttgatcctgacaatggtgagactgaatttgccccgaagttcccgggcaaggtcaccatgaccacagacacgtccatcagcacagcctacatggagctgagcaggctgagatctgacgacacggccgtgtattactgtgcgagagaagactacgatggtacctacacctggtttccttattggggccaagggactctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 235 - protein, 466 aa, Artificial Sequence
  Synthetic Polypeptide
  MISC_FEATURE: Humanized Antibody Sequence
MDWTWRILFLVAAATGAHSEVQLVQSGAEVKKPGASVKVSCKASGFDIKDYYIHWVRQAPGQGLEWIGRVDPDNGETEFAPKFPGKVTMTTDTSISTAYMELSRLRSDDTAVYYCAREDYDGTYTWFPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 236 - DNA, 1398 bp, Artificial Sequence
  Synthetic Polynucleotide
  misc_feature: Humanized Antibody Sequence
atggactggacctggaggatcctcttcttggtggcagcagccacaggagcccactccgaggtgcagctggtgcagtctggggctgaggtgaagaagcctggggcctcagtgaaggtctcctgcaaggcttctggattcgacattaaggactactatatacactgggtgcgacaggcccctggacaagggcttgagtggatcggaagggttgatcctgacaatggtgagactgaatttgccccgaagttcccgggcaaggtcaccatgaccacagacacgtccatcagcacagcctacatggagctgagcaggctgagatctgacgacacggccgtgtattactgtgcgagagaagactacgatggtacctacacctggtttccttattggggccaagggactctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 237 - protein, 7 aa, Mus musculus
GTSNLAS

SEQ ID NO: 238 - protein, 8 aa, Mus musculus
QQWTTTYT

SEQ ID NO: 239 - protein, 11 aa, Mus musculus
RASQDISSYLN

SEQ ID NO: 240 - protein, 7 aa, Mus musculus
STSRLNS

SEQ ID NO: 241 - protein, 8 aa, Mus musculus
QQDIKHPT

SEQ ID NO: 242 - protein, 11 aa, Mus musculus
KASQDVFTAVA

SEQ ID NO: 243 - protein, 7 aa, Mus musculus
WASTRHT

SEQ ID NO: 244 - protein, 9 aa, Mus musculus
QQYSSYPLT

SEQ ID NO: 245 - protein, 5 aa, Mus musculus
DYNMH

SEQ ID NO: 246 - protein, 17 aa, Mus musculus
EINPNSGGAGYNQKFKG

SEQ ID NO: 247 - protein, 14 aa, Mus musculus
LGYDDIYDDWYFDV

SEQ ID NO: 248 - protein, 5 aa, Mus musculus
DYNMH

SEQ ID NO: 249 - protein, 17 aa, Mus musculus
EINPNSGGSGYNQKFKG

SEQ ID NO: 250 - protein, 14 aa, Mus musculus
LVYDGSYEDWYFDV

SEQ ID NO: 251 - protein, 5 aa, Mus musculus
DYNMH

SEQ ID NO: 252 - protein, 17 aa, Mus musculus
EINPNSGGAGYNQQFKG

SEQ ID NO: 253 - protein, 14 aa, Mus musculus
LGYVGNYEDWYFDV

SEQ ID NO: 254 - protein, 5 aa, Mus musculus
DYNMH

SEQ ID NO: 255 - protein, 17 aa, Mus musculus
EINPNSGGAGYNQKFKG

SEQ ID NO: 256 - protein, 14 aa, Mus musculus
LGYDDIYDDWYFDV

SEQ ID NO: 257 - protein, 5 aa, Mus musculus
DYNMH

SEQ ID NO: 258 - protein, 17 aa, Mus musculus
EINPNSGGAGYNQKFKG

SEQ ID NO: 259 - protein, 14 aa, Mus musculus
LGYDDIYDDWYFDV

SEQ ID NO: 260 - protein, 5 aa, Mus musculus
DYNMH

SEQ ID NO: 261 - protein, 17 aa, Mus musculus
EINPNSGGAGYNQKFKG

SEQ ID NO: 262 - protein, 14 aa, Mus musculus
LGYDDIYDDWYFDV

SEQ ID NO: 263 - protein, 5 aa, Mus musculus
DYNMH

SEQ ID NO: 264 - protein, 17 aa, Mus musculus
EINPNSGGSGYNQKFKG

SEQ ID NO: 265 - protein, 14 aa, Mus musculus
LGYYGNYEDWYFDV

SEQ ID NO: 266 - protein, 5 aa, Mus musculus
DYYIH

SEQ ID NO: 267 - protein, 17 aa, Mus musculus
RIDPDNGESTYVPKFQG

SEQ ID NO: 268 - protein, 13 aa, Mus musculus
EGLDYGDYYAVDY

SEQ ID NO: 269 - protein, 5 aa, Mus musculus
DYIMH

SEQ ID NO: 270 - protein, 17 aa, Mus musculus
YINPYNDDTEYNEKFKG

SEQ ID NO: 271 - protein, 11 aa, Mus musculus
SIYYYDAPFAY

SEQ ID NO: 272 - protein, 5 aa, Mus musculus
DYYMH

SEQ ID NO: 273 - protein, 17 aa, Mus musculus
RIDPENGDIIYDPKFQG

SEQ ID NO: 274 - protein, 10 aa, Mus musculus
DAGDPAWFTY

SEQ ID NO: 275 - protein, 10 aa, Mus musculus
RASSSVYYMH

SEQ ID NO: 276 - protein, 7 aa, Mus musculus
ATSNLAS

SEQ ID NO: 277 - protein, 9 aa, Mus musculus
QQWSSDPLT

SEQ ID NO: 278 - protein, 12 aa, Mus musculus
SVSSTISSNHLH

SEQ ID NO: 279 - protein, 7 aa, Mus musculus
GTSNLAS

SEQ ID NO: 280 - protein, 9 aa, Mus musculus
QQWSSYPLT

SEQ ID NO: 281 - protein, 10 aa, Mus musculus
RASSSISYIH

SEQ ID NO: 282 - protein, 7 aa, Mus musculus
ATSNLAS

SEQ ID NO: 283 - protein, 9 aa, Mus musculus
QQWSSDPLT

SEQ ID NO: 284 - protein, 12 aa, Mus musculus
RASSSVTSSYLN

SEQ ID NO: 285 - protein, 7 aa, Mus musculus
STSNLAS

SEQ ID NO: 286 - protein, 9 aa, Mus musculus
QQYDFFPST

SEQ ID NO: 287 - protein, 5 aa, Mus musculus
DYFIH

SEQ ID NO: 288 - protein, 17 aa, Mus musculus
RLDPEDGESDYAPKFQD

SEQ ID NO: 289 - protein, 12 aa, Mus musculus
EDYDGTYTFFPY

SEQ ID NO: 290 - protein, 5 aa, Mus musculus
DFYLH

SEQ ID NO: 291 - protein, 17 aa, Mus musculus
RIDPENGDTLYDPKFQD

SEQ ID NO: 292 - protein, 16 aa, Mus musculus
EADYFHDGTSYWYFDV

SEQ ID NO: 293 - protein, 5 aa, Mus musculus
DYYIH

SEQ ID NO: 294 - protein, 17 aa, Mus musculus
RVDPDNGETEFAPKFPG

SEQ ID NO: 295 - protein, 12 aa, Mus musculus
EDYDGTYTWFPY

SEQ ID NO: 296 - protein, 5 aa, Mus musculus
DYYMN

SEQ ID NO: 297 - protein, 17 aa, Mus musculus
DINPYNDDTTYNHKFKG

SEQ ID NO: 298 - protein, 11 aa, Mus musculus
ETAVITTNAMD

SEQ ID NO: 299 - protein, 130 aa, Mus musculus
MDFQVQIFSFMLISVTVILSSGEIVLTQSPALMAASPGEKVTITCSVSSSISSSNLHWSQQKSGTSPKLWIYGTSNLASGVPVRFSGSGSGTSYSLTISSMEAEDAATYYCQQWTTTYTFGSGTKLELKR

SEQ ID NO: 300 - DNA, 390 bp, Mus musculus
atggattttcaggtgcagattttcagcttcatgctaatcagtgtcacagtcatattgtccagtggagaaattgtgctcacccagtctccagcactcatggctgcatctccaggggagaaggtcaccatcacctgcagtgtcagctcgagtataagttccagcaacttacactggtcccagcagaagtcaggaacctcccccaaactctggatttatggcacatccaaccttgcttctggagtccctgttcgcttcagtggcagtggatctgggacctcttattctctcacaatcagcagcatggaggctgaagatgctgccacttattactgtcaacagtggactactacgtatacgttcggatcggggaccaagctggagctgaaacgt

SEQ ID NO: 301 - protein, 141 aa, Mus musculus
MGWNWIIFFLMAVVTGVNSEVQLRQSGADLVKPGASVKLSCTASGFNIKDYYIHWVKQRPEQGLEWIGRIDPDNGESTYVPKFQGKATITADTSSNTAYLQLRSLTSEDTAIYYCGREGLDYGDYYAVDYWGQGTSVTVSS

SEQ ID NO: 302 - DNA, 423 bp, Mus musculus
atgggatggaactggatcatcttcttcctgatggcagtggttacaggggtcaattcagaggtgcagttgcggcagtctggggcagaccttgtgaagccaggggcctcagtcaagttgtcctgcacagcttctggcttcaacattaaagactactatatacactgggtgaagcagaggcctgaacagggcctggagtggattggaaggattgatcctgataatggtgaaagtacatatgtcccgaagttccagggcaaggccactataacagcagacacatcatccaacacagcctacctacaactcagaagcctgacatctgaggacactgccatctattattgtgggagagaggggctcgactatggtgactactatgctgtggactactggggtcaaggaacctcggtcacagtctcgagc

SEQ ID NO: 303 - protein, 130 aa, Artificial Sequence
  Synthetic Polypeptide
  MISC_FEATURE: Humanized Antibody Sequence
MDMRVPAQLLGLLLLWLPGARCDIQLTQSPSFLSASVGDRVTITCSVSSSISSSNLHWYQQKPGKAPKLLIYGTSNLASGVPSRFSGSGSGTEFTLTISSLQPEDFATYYCQQWTTTYTFGQGTKLEIKR

SEQ ID NO: 304 - DNA, 390 bp, Artificial Sequence
  Synthetic Polynucleotide
  misc_feature: Humanized Antibody Sequence
atggatatgcgcgtgccggcgcagctgctgggcctgctgctgctgtggctgccgggcgcgcgctgcgatattcagctgacccagagcccgagctttctgagcgcgagcgtgggcgatcgcgtgaccattacctgcagcgtgagcagcagcattagcagcagcaacctgcattggtatcagcagaaaccgggcaaagcgccgaaactgctgatttatggcaccagcaacctggcgagcggcgtgccgagccgctttagcggcagcggcagcggcaccgaatttaccctgaccattagcagcctgcagccggaagattttgcgacctattattgccagcagtggaccaccacctatacctttggccagggcaccaaactggaaattaaacgt

SEQ ID NO: 305 - protein, 141 aa, Artificial Sequence
  Synthetic Polypeptide
  MISC_FEATURE: Humanized Antibody Sequence
MDWTWSILFLVAAPTGAHSEVQLVQSGAEVKKPGASVKVSCKASGFNIKDYYIHWVRQAPGQGLEWMGRIDPDNGESTYVPKFQGRVTMTTDTSTSTAYMELRSLRSDDTAVYYCAREGLDYGDYYAVDYWGQGTLVTVSS

SEQ ID NO: 306 - DNA, 423 bp, Artificial Sequence
  Synthetic Polynucleotide
  misc_feature: Humanized Antibody Sequence
atggattggacctggagcattctgtttctggtggcggcgccgaccggcgcgcatagcgaagtgcagctggtgcagagcggcgcggaagtgaaaaaaccgggcgcgagcgtgaaagtgagctgcaaagcgagcggctttaacattaaagattattatattcattgggtgcgccaggcgccgggccagggcctggaatggatgggccgcattgatccggataacggcgaaagcacctatgtgccgaaatttcagggccgcgtgaccatgaccaccgataccagcaccagcaccgcgtatatggaactgcgcagcctgcgcagcgatgataccgcggtgtattattgcgcgcgcgaaggcctggattatggcgattattatgcggtggattattggggccagggcaccctggtgaccgtctcgagc

SEQ ID NO: 307 - protein, 127 aa, Artificial Sequence
  Synthetic Polypeptide
  MISC_FEATURE: Humanized Antibody Sequence
MMSSAQFLGLLLLCFQGTRCDIQMTQTTSSLSASLGDRVNISCRASQDISSYLNWYQQKPDGTVKLLIYSTSRLNSGVPSRFSGSGSGTDYSLTISNLAQEDIATYFCQQDIKHPTFGGGTKLELKR

SEQ ID NO: 308 - DNA, 381 bp, Mus musculus
atgatgtcctctgctcagttccttggtctcctgttgctctgttttcaaggtaccagatgtgatatccagatgacacagactacatcctccctgtctgcctctctgggagacagagtcaacatcagctgcagggcaagtcaggacattagcagttatttaaactggtatcagcagaaaccagatggaactgttaaactcctgatctactccacatcaagattaaactcaggagtcccatcaaggttcagtggcagtgggtctgggacagattattctctcactattagcaacctggcacaagaagatattgccacttacttttgccaacaggatattaagcatccgacgttcggtggaggcaccaagttggagctgaaacgt

SEQ ID NO: 309 - protein, 139 aa, Mus musculus
MEWIWIFLFLLSGTAGVHSEVQLQQSGPELVKPGASVKMSCKASGFTFTDYIMHWVKQKPGQGLEWIGYINPYNDDTEYNEKFKGKATLTSDKSSSTAYMDLSSLTSEGSAVYYCARSIYYYDAPFAYWGQGTLVTVSS

SEQ ID NO: 310 - DNA, 417 bp, Mus musculus
atggaatggatctggatatttctcttcctcctgtcaggaactgcaggtgtccactctgaggtccagctgcagcagtctggacctgagctggtaaagcctggggcttcagtgaagatgtcctgcaaggcttctgggttcacattcactgactacattatgcactgggtgaagcagaagcctgggcagggccttgagtggattggatatattaatccttacaatgatgatactgaatacaatgagaagttcaaaggcaaggccacactgacttcagacaaatcctccagcacagcctacatggatctcagcagtctgacctctgagggctctgcggtctattactgtgcaagatcgatttattactacgatgccccgtttgcttactggggccaagggactctggtcacagtctcgagc

SEQ ID NO: 311 - protein, 127 aa, Artificial Sequence
  Synthetic Polypeptide
  MISC_FEATURE: Humanized Antibody Sequence
MMSSAQFLGLLLLCFQGTRCDIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIKR

SEQ ID NO: 312 - DNA, 381 bp, Artificial Sequence
  Synthetic Polynucleotide
  misc_feature: Humanized Antibody Sequence
atgatgtcctctgctcagttccttggtctcctgttgctctgttttcaaggtaccagatgtgatatccagatgacccagtctccatcctccctgtctgcatctgtaggtgaccgtgtcaccatcacttgccgcgcaagtcaggatattagcagctatttaaattggtatcagcagaaaccagggaaagcccctaagctcctgatctattctacttcccgtttgaatagtggggtcccatcacgcttcagtggcagtggctctgggacagatttcactctcaccatcagcagtctgcaacctgaagattttgcaacttactactgtcaacaggatattaaacaccctacgttcggtcaaggcaccaaggtggagatcaaacgt

SEQ ID NO: 313 - protein, 139 aa, Artificial Sequence
  Synthetic Polypeptide
  MISC_FEATURE: Humanized Antibody Sequence
MEWIWIFLFLLSGTAGVHSEVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSS

SEQ ID NO: 314 - protein, 107 aa, Mus musculus
DIQMTQTTSSLSASLGDRVNISCRASQDISSYLNWYQQKPDGTVKLLIYSTSRLNSGVPSRFSGSGSGTDYSLTISNLAQEDIATYFCQQDIKHPTFGGGTKLELKR

SEQ ID NO: 315 - protein, 128 aa, Mus musculus
MKSQTQVFVYMLLWLSGVEGDIVMTQSHKFMSTSVGDRVTITCKASQDVFTAVAWYQQKPGQSPKLLIYWASTRHTGVPDRFTGSGSGTDFTLTISNVQSEDLADYFCQQYSSYPLTFGAGTKLELKR

SEQ ID NO: 316 - DNA, 381 bp, Mus musculus
atgaagtcacagacccaggtctttgtatacatgttgctgtggttgtctggtgttgaaggagacattgtgatgacccagtctcacaaattcatgtccacgtcagtaggagacagggtcaccatcacctgcaaggccagtcaggatgtctttactgctgtagcctggtatcaacagaaaccaggacaatctcctaaactactgatttactgggcatccacccggcacactggagtccctgatcgcttcacaggcagtggatctgggacagatttcactctcaccattagcaatgtgcagtctgaagacttggcagattatttctgtcaacaatatagcagctatcctctcacgttcggtgctgggaccaagttggagctgaaa

SEQ ID NO: 317 - protein, 138 aa, Mus musculus
MGWNWIIFFLMAVVTGVNSEVQLQQSGAELVRPGALVKLSCKASGFNIKDYYMHWVKQRPEQGLEWIGRIDPENGDIIYDPKFQGKASITTDTSSNTAYLQLSSLTSEDTAVYYCAYDAGDPAWFTYWGQGTLVTVSS

SEQ ID NO: 318 - DNA, 411 bp, Mus musculus
atgggatggaactggatcatcttcttcctgatggcagtggttacaggggtcaattcagaggttcagctgcagcagtctggggctgagcttgtgaggccaggggccttagtcaagttgtcctgcaaagcttctggcttcaatattaaagactactatatgcactgggtgaagcagaggcctgaacagggcctggagtggattggaaggattgatcctgagaatggtgatattatatatgacccgaagttccagggcaaggccagtataacaacagacacatcctccaacacagcctacctgcagctcagcagcctgacgtctgaggacactgccgtctattactgtgcttacgatgctggtgaccccgcctggtttacttactggggccaagggactctggtcaccgtctcg

SEQ ID NO: 319 - protein, 130 aa, Mus musculus
MDMRVPAQLLGLLLLWLRGARCDIQMTQSPSSLSASVGDRVTITCKASQDVFTAVAWYQQKPGKAPKLLIYWASTRHTGVPSRFSGSGSGTDFTLTISSLQPEDFATYYCQQYSSYPLTFGGGTKVEIKR

SEQ ID NO: 320 - DNA, 390 bp, Mus musculus
atggatatgcgcgtgccggcgcagctgctgggcctgctgctgctgtggctgcgcggcgcgcgctgcgatatccagatgacccagagcccgagcagcctgagcgcgagcgtgggcgatcgcgtgaccattacctgcaaagcgagccaggatgtgtttaccgcggtggcgtggtatcagcagaaaccgggcaaagcgccgaaactgctgatttattgggcgagcacccgccataccggcgtgccgagtcgctttagcggcagcggcagcggcaccgattttaccctgaccattagcagcctgcagccggaagattttgcgacctattattgccagcagtatagcagctatccgctgacctttggcggcggcaccaaagtggaaattaaacgt

SEQ ID NO: 321 - protein, 138 aa, Artificial Sequence
  Synthetic Polypeptide
  MISC_FEATURE: Humanized Antibody Sequence
MDWTWSILFLVAAPTGAHSEVQLVQSGAEVKKPGASVKVSCKASGFNIKDYYMHWVRQAPGQGLEWIGRIDPENGDIIYDPKFQGRVTMTTDTSTSTAYMELRSLRSDDTAVYYCAYDAGDPAWFTYWGQGTLVTVSS

SEQ ID NO: 322 - DNA, 414 bp, Artificial Sequence
  Synthetic Polynucleotide
  misc_feature: Humanized Antibody Sequence
atggattggacctggagcattctgtttctggtggcggcgccgaccggcgcgcatagcgaagtgcagctggtgcagagcggcgcggaagtgaaaaaaccgggcgcgagcgtgaaagtgagctgcaaagcgagcggctttaacattaaagattattatatgcattgggtgcgccaggcgccgggccagggcctggaatggatcggccgcattgatccggaaaacggcgatattatttatgatccgaaatttcagggccgcgtgaccatgaccaccgataccagcaccagcaccgcgtatatggaactgcgcagcctgcgcagcgatgataccgcggtgtattattgcgcgtatgatgcgggcgatccggcgtggtttacctattggggccagggcaccctggtgaccgtctcgagc

SEQ ID NO: 323 - protein, 106 aa, Mus musculus
TDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 324 - protein, 320 aa, Mus musculus
AKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSH

SEQ ID NO: 325 - protein, 106 aa, Homo sapiens
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 326 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 327 - protein, 120 aa, Mus musculus
EVQLQQSGPELVKPGASVKMSCKASGFTFTDYIMHWVKQKPGQGLEWIGYINPYNDDTEYNEKFKGKATLTSDKSSSTAYMDLSSLTSEGSAVYYCARSIYYYDAPFAYWGQGTLVTVSS

SEQ ID NO: 328 - protein, 120 aa, Mus musculus; identical to SEQ ID NO: 327

SEQ ID NO: 329 - protein, 120 aa, Mus musculus
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSS

SEQ ID NO: 330 - protein, 226 aa, Mus musculus
EVQLQQSGPELVKPGASVKMSCKASGFTFTDYIMHWVKQKPGQGLEWIGYINPYNDDTEYNEKFKGKATLTSDKSSSTAYMDLSSLTSEGSAVYYCARSIYYYDAPFAYWGQGTLVTVSSTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 331 - protein, 447 aa, Mus musculus
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 332 - protein, 107 aa, Mus musculus
DIQMTQITSSLSASLGDRVSISCRASQDISNYLNWYQQKPDGTFKLLIFYTSRLLSGVPSRFSGSGSGTDYSLTIYNLEQEDFATYFCQQGDTLPYTFGGGTKLEIK

SEQ ID NO: 333 - protein, 324 aa, Mus musculus
AKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 334 - protein, 213 aa, Mus musculus
DIQMTQTTSSLSASLGDRVNISCRASQDISSYLNWYQQKPDGTVKLLIYSTSRLNSGVPSRFSGSGSGTDYSLTISNLAQEDIATYFCQQDIKHPTFGGGTKLELKRTDAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 335 - protein, 444 aa, Mus musculus
EVQLQQSGPELVKPGASVKMSCKASGFTFTDYIMHWVKQKPGQGLEWIGYINPYNDDTEYNEKFKGKATLTSDKSSSTAYMDLSSLTSEGSAVYYCARSIYYYDAPFAYWGQGTLVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 336 - protein, 108 aa, Mus musculus
DIQMTQSPSSLSASVGDRVTITCKASQDVFTAVAWYQQKPGKAPKLLIYWASTRHTGVPSRFSGSGSGTDFTLTISSLQPEDFATYYCQQYSSYPLTFGGGTKVEIKR

SEQ ID NO: 337 - DNA, 324 bp, Mus musculus
gatatccagatgacccagagcccgagcagcctgagcgcgagcgtgggcgatcgcgtgaccattacctgcaaagcgagccaggatgtgtttaccgcggtggcgtggtatcagcagaaaccgggcaaagcgccgaaactgctgatttattgggcgagcacccgccataccggcgtgccgagtcgctttagcggcagcggcagcggcaccgattttaccctgaccattagcagcctgcagccggaagattttgcgacctattattgccagcagtatagcagctatccgctgacctttggcggcggcaccaaagtggaaattaaacgt

SEQ ID NO: 338 - protein, 119 aa, Mus musculus
EVQLVQSGAEVKKPGASVKVSCKASGFNIKDYYMHWVRQAPGQGLEWIGRIDPENGDIIYDPKFQGRVTMTTDTSTSTAYMELRSLRSDDTAVYYCAYDAGDPAWFTYWGQGTLVTVSS

SEQ ID NO: 339 - DNA, 357 bp, Mus musculus
gaagtgcagctggtgcagagcggcgcggaagtgaaaaaaccgggcgcgagcgtgaaagtgagctgcaaagcgagcggctttaacattaaagattattatatgcattgggtgcgccaggcgccgggccagggcctggaatggatcggccgcattgatccggaaaacggcgatattatttatgatccgaaatttcagggccgcgtgaccatgaccaccgataccagcaccagcaccgcgtatatggaactgcgcagcctgcgcagcgatgataccgcggtgtattattgcgcgtatgatgcgggcgatccggcgtggtttacctattggggccagggcaccctggtgaccgtctcgagc

SEQ ID NO: 340 - DNA, 1395 bp, Mus musculus
atggactggacctggaggatcctcttcttggtggcagcagccacaggagcccactccgaggtgcagctggtgcagtctggggctgaggtgaagaagcctgggtcctcggtgaaggtctcctgcaaggcttctggttttaccttcaccgactatattatgcactgggtgcgtcaggcccctggtcaagggcttgagtggatgggctatatcaacccttataatgatgacaccgaatacaacgagaagttcaagggccgtgtcacgattaccgcggacaaatccacgagcacagcctacatggagctgagcagcctgcgctctgaggacacggccgtgtattactgtgcgcgttcgatttattactacgatgccccgtttgcttactggggccaagggactctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 341 - protein, 213 aa, Mus musculus
DIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 342 - DNA, 639 bp, Mus musculus
gacatccagatgacccagtctccatcctccctgtctgcatctgtaggtgaccgtgtcaccatcacttgccgcgcaagtcaggatattagcagctatttaaattggtatcagcagaaaccagggaaagcccctaagctcctgatctattctacttcccgtttgaatagtggggtcccatcacgcttcagtggcagtggctctgggacagatttcactctcaccatcagcagtctgcaacctgaagattttgcaacttactactgtcaacaggatattaaacaccctacgttcggtcaaggcaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 343 - protein, 235 aa, Mus musculus
MDMRVPAQLLGLLLLWLRGARCDIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 344 - DNA, 705 bp, Mus musculus
atggacatgagggtgcccgctcagctcctggggctcctgctgctgtggctgagaggtgccagatgtgacatccagatgacccagtctccatcctccctgtctgcatctgtaggtgaccgtgtcaccatcacttgccgcgcaagtcaggatattagcagctatttaaattggtatcagcagaaaccagggaaagcccctaagctcctgatctattctacttcccgtttgaatagtggggtcccatcacgcttcagtggcagtggctctgggacagatttcactctcaccatcagcagtctgcaacctgaagattttgcaacttactactgtcaacaggatattaaacaccctacgttcggtcaaggcaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 345 - protein, 446 aa, Mus musculus
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 346 - DNA, 1338 bp, Mus musculus
gaggtgcagctggtgcagtctggggctgaggtgaagaagcctgggtcctcggtgaaggtctcctgcaaggcttctggttttaccttcaccgactatattatgcactgggtgcgtcaggcccctggtcaagggcttgagtggatgggctatatcaacccttataatgatgacaccgaatacaacgagaagttcaagggccgtgtcacgattaccgcggacaaatccacgagcacagcctacatggagctgagcagcctgcgctctgaggacacggccgtgtattactgtgcgcgttcgatttattactacgatgccccgtttgcttactggggccaagggactctggtcaccgtctctagtgcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 347 - protein, 465 aa, Mus musculus
MDWTWRILFLVAAATGAHSEVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 348 - DNA, 1395 bp, Mus musculus; identical to SEQ ID NO: 340

SEQ ID NO: 349 - DNA, 417 bp, Mus musculus
atggaatggatctggatatttctcttcctcctgtcaggaactgcaggtgtccactctgaggtgcagctggtgcagtctggggctgaggtgaagaagcctgggtcctcggtgaaggtctcctgcaaggcttctggttttaccttcaccgactatattatgcactgggtgcgtcaggcccctggtcaagggcttgagtggatgggctatatcaacccttataatgatgacaccgaatacaacgagaagttcaagggccgtgtcacgattaccgcggacaaatccacgagcacagcctacatggagctgagcagcctgcgctctgaggacacggccgtgtattactgtgcgcgttcgatttattactacgatgccccgtttgcttactggggccaagggactctggtcacagtctcgagc

SEQ ID NO: 350 - protein, 218 aa, Mus musculus
DIVLTQSPASLAVSLGQRATIACKASQSVDYDGTSYMNWYQQKPGQPPKLLIYAASNLESEIPARFSGTGSGTDFTLNIHPVEEEDITTYYCQQSNEDPFTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 351 - protein, 15 aa, Mus musculus
KASQSVDYDGTSYMN

SEQ ID NO: 352 - protein, 7 aa, Mus musculus
AASNLES

SEQ ID NO: 353 - protein, 9 aa, Mus musculus
QQSNEDPFT

SEQ ID NO: 354 - DNA, 657 bp, Mus musculus
gacattgtgttgacccagtctccagcttctttggctgtgtctctagggcagagggccaccatcgcctgcaaggccagccaaagtgttgattatgatggtactagttatatgaattggtaccaacagaaaccaggacagccacccaaactcctcatctatgctgcatccaatctagaatctgagatcccagccaggtttagtggcactgggtctgggacagacttcaccctcaacatccatcctgtggaggaggaggatatcacaacctattactgtcagcaaagtaatgaggatccgttcacgttcggaggggggaccaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 355 - protein, 238 aa, Mus musculus
METDTILLWVLLLWVPGSTGDIVLTQSPASLAVSLGQRATIACKASQSVDYDGTSYMNWYQQKPGQPPKLLIYAASNLESEIPARFSGTGSGTDFTLNIHPVEEEDITTYYCQQSNEDPFTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 356 - DNA, 717 bp, Mus musculus
atggagacagacacaatcctgctatgggtgctgctgctctgggttccaggctccactggtgacattgtgttgacccagtctccagcttctttggctgtgtctctagggcagagggccaccatcgcctgcaaggccagccaaagtgttgattatgatggtactagttatatgaattggtaccaacagaaaccaggacagccacccaaactcctcatctatgctgcatccaatctagaatctgagatcccagccaggtttagtggcactgggtctgggacagacttcaccctcaacatccatcctgtggaggaggaggatatcacaacctattactgtcagcaaagtaatgaggatccgttcacgttcggaggggggaccaagttggaaataaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 357 - protein, 442 aa, Mus musculus
QVQLQQPGTELVRPGTSVKLSCKASGYIFTTYWMNWVKQRPGQGLEWIGMIHPSASEIRLDQKFKDKATLTLDKSSSTAYMHLSGPTSVDSAVYYCARSGEWGSMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 358 - protein, 5 aa, Mus musculus
TYWMN

SEQ ID NO: 359 - protein, 17 aa, Mus musculus
MIHPSASEIRLDQKFKD

SEQ ID NO: 360 - protein, 9 aa, Mus musculus
SGEWGSMDY

SEQ ID NO: 361 - DNA, 1329 bp, Mus musculus
caggtccaactacagcagcctgggactgagctggtgaggcctggaacttcagtgaagttgtcctgtaaggcttctggctacatcttcaccacctactggatgaactgggtgaaacagaggcctggacaaggccttgagtggattggcatgattcatccttccgcaagtgaaattaggttggatcagaaattcaaggacaaggccacattgactcttgacaaatcctccagcacagcctatatgcacctcagcggcccgacatctgtggattctgcggtctattactgtgcaagatcaggggaatgggggtctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 362 - protein, 461 aa, Mus musculus
MGWSSIILFLVATATGVHSQVQLQQPGTELVRPGTSVKLSCKASGYIFTTYWMNWVKQRPGQGLEWIGMIHPSASEIRLDQKFKDKATLTLDKSSSTAYMHLSGPTSVDSAVYYCARSGEWGSMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFIYSKLNVQKSNWEAGNTFTCSVLHEGLHNHHTEKSLSHSPGK

SEQ ID NO: 363 - DNA, 1386 bp, Mus musculus
atgggatggagctctatcatcctcttcttggtagcaacagctacaggtgtccactcccaggtccaactacagcagcctgggactgagctggtgaggcctggaacttcagtgaagttgtcctgtaaggcttctggctacatcttcaccacctactggatgaactgggtgaaacagaggcctggacaaggccttgagtggattggcatgattcatccttccgcaagtgaaattaggttggatcagaaattcaaggacaaggccacattgactcttgacaaatcctccagcacagcctatatgcacctcagcggcccgacatctgtggattctgcggtctattactgtgcaagatcaggggaatgggggtctatggactactggggtcaaggaacctcagtcaccgtctcctcagccaaaacgacacccccatctgtctatccactggcccctggatctgctgcccaaactaactccatggtgaccctgggatgcctggtcaagggctatttccctgagccagtgacagtgacctggaactctggatccctgtccagcggtgtgcacaccttcccagctgtcctgcagtctgacctctacactctgagcagctcagtgactgtcccctccagcacctggcccagcgagaccgtcacctgcaacgttgcccacccggccagcagcaccaaggtggacaagaaaattgtgcccagggattgtggttgtaagccttgcatatgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcatctacagcaagctcaatgtgcagaagagcaactgggaggcaggaaatactttcacctgctctgtgttacatgagggcctgcacaaccaccatactgagaagagcctctcccactctcctggtaaatga

SEQ ID NO: 364 - protein, 106 aa, Mus musculus
DIQMTQSPSSLSASVGDRVTITCRASQDISSYLNWYQQKPGKAPKLLIYSTSRLNSGVPSRFSGSGSGTDFTLTISSLQPEDFATYYCQQDIKHPTFGQGTKVEIK

SEQ ID NO: 365 - DNA, 318 bp, Mus musculus
gacatccagatgacccagtctccatcctccctgtctgcatctgtaggtgaccgtgtcaccatcacttgccgcgcaagtcaggatattagcagctatttaaattggtatcagcagaaaccagggaaagcccctaagctcctgatctattctacttcccgtttgaatagtggggtcccatcacgcttcagtggcagtggctctgggacagatttcactctcaccatcagcagtctgcaacctgaagattttgcaacttactactgtcaacaggatattaaacaccctacgttcggtcaaggcaccaaggtggagatcaaa

SEQ ID NO: 366 - protein, 120 aa, Mus musculus; identical to SEQ ID NO: 329

SEQ ID NO: 367 - DNA, 360 bp, Mus musculus
gaggtgcagctggtgcagtctggggctgaggtgaagaagcctgggtcctcggtgaaggtctcctgcaaggcttctggttttaccttcaccgactatattatgcactgggtgcgtcaggcccctggtcaagggcttgagtggatgggctatatcaacccttataatgatgacaccgaatacaacgagaagttcaagggccgtgtcacgattaccgcggacaaatccacgagcacagcctacatggagctgagcagcctgcgctctgaggacacggccgtgtattactgtgcgcgttcgatttattactacgatgccccgtttgcttactggggccaagggactctggtcaccgtctctagt

SEQ ID NO: 368 - protein, 108 aa, Mus musculus; identical to SEQ ID NO: 336

SEQ ID NO: 369 - DNA, 324 bp, Mus musculus; identical to SEQ ID NO: 337

SEQ ID NO: 370 - protein, 119 aa, Mus musculus; identical to SEQ ID NO: 338

SEQ ID NO: 371 - DNA, 357 bp, Mus musculus; identical to SEQ ID NO: 339

SEQ ID NO: 372 - protein, 108 aa, Mus musculus
DIQLTQSPSFLSASVGDRVTITCSVSSSISSSNLHWYQQKPGKAPKLLIYGTSNLASGVPSRFSGSGSGTEFTLTISSLQPEDFATYYCQQWTTTYTFGQGTKLEIKR

SEQ ID NO: 373 - DNA, 324 bp, Mus musculus
gatattcagctgacccagagcccgagctttctgagcgcgagcgtgggcgatcgcgtgaccattacctgcagcgtgagcagcagcattagcagcagcaacctgcattggtatcagcagaaaccgggcaaagcgccgaaactgctgatttatggcaccagcaacctggcgagcggcgtgccgagccgctttagcggcagcggcagcggcaccgaatttaccctgaccattagcagcctgcagccggaagattttgcgacctattattgccagcagtggaccaccacctatacctttggccagggcaccaaactggaaattaaacgt

SEQ ID NO: 374 - protein, 122 aa, Mus musculus
EVQLVQSGAEVKKPGASVKVSCKASGFNIKDYYIHWVRQAPGQGLEWMGRIDPDNGESTYVPKFQGRVTMTTDTSTSTAYMELRSLRSDDTAVYYCAREGLDYGDYYAVDYWGQGTLVTVSS

SEQ ID NO: 375 - DNA, 366 bp, Mus musculus
gaagtgcagctggtgcagagcggcgcggaagtgaaaaaaccgggcgcgagcgtgaaagtgagctgcaaagcgagcggctttaacattaaagattattatattcattgggtgcgccaggcgccgggccagggcctggaatggatgggccgcattgatccggataacggcgaaagcacctatgtgccgaaatttcagggccgcgtgaccatgaccaccgataccagcaccagcaccgcgtatatggaactgcgcagcctgcgcagcgatgataccgcggtgtattattgcgcgcgcgaaggcctggattatggcgattattatgcggtggattattggggccagggcaccctggtgaccgtctcgagc

SEQ ID NO: 376 - protein, 107 aa, Mus musculus [sequence omitted]

SEQ ID NO: 377 - DNA, 321 bp, Mus musculus
gacatccagatgacccagtctccatcctccctctccgcatccgtaggcgaccgcgtaaccataacatgtagagcatctcaagatatttccaactatttgaattggtaccaacaaaaacccggcaaagcacctaaactcctcatttactatacatcaagactcctctccggcgttccatcacgattctcaggctccggctccggcacagatttcacactcactatttcctccctccaaccagaagattttgcaacctattactgtcaacaaggcgatacactcccatacacattcggcggcggcacaaaagttgaaattaaa

SEQ ID NO: 378 - protein, 123 aa, Mus musculus [sequence omitted]

SEQ ID NO: 379 - DNA, 369 bp, Mus musculus
gaggtgcagctggtgcagagcggcgccgaggtaaaaaaaccaggagcaagcgttaaagtttcttgtaaagcaagcggatatacatttacagattacaacatgcattgggtaagacaagcgccaggacaaggattggaatggatgggcgaaattaaccctaatagtggaggagcaggctacaatcaaaaattcaaagggagagttacaatgacaacagacacaagcacttcaacagcatatatggaactgcgatcacttagaagcgacgatacagctgtatactattgcgcacgacttgggtatgatgatatatatgatgactggtatttcgatgtttggggccagggaacaacagttaccgtctctagt

SEQ ID NO: 380 - protein, 108 aa, Mus musculus
DIQLTQSPSFLSASVGDRVTITCRASSSVTSSYLNWYQQKPGKAPKLLIYSTSNLASGVPSRFSGSGSGTEFTLTISSLQPEDFATYYCQQYDFFPSTFGGGTKVEIK

SEQ ID NO: 381 - DNA, 324 bp, Mus musculus
gacatccagctgacccagagccccagcttcctttccgcatccgttggtgaccgagtaacaatcacatgccgcgcctcatcttcagttacatcttcttatcttaattggtatcaacaaaaaccaggaaaagcacctaaacttcttatatactctacatctaatctcgcatcaggagttccctctcgattttcaggatctggatcaggcacagaatttacacttactatatcatcactccaaccagaagacttcgccacttattactgccaacaatacgatttttttccaagcacattcggaggaggtacaaaagtagaaatcaag

SEQ ID NO: 382 - protein, 121 aa, Mus musculus
EVQLVQSGAEVKKPGASVKVSCKASGYTFTDYYMNWVRQAPGQRLEWMGDINPYNDDTTYNHKFKGRVTITRDTSASTAYMELSSLRSEDTAVYYCARETAVITTNAMDYWGQGTTVTVSS

SEQ ID NO: 383 - DNA, 363 bp, Mus musculus
gaggtgcagctggtgcagagcggcgccgaggtcaagaaacctggagcaagcgtaaaggttagttgcaaagcatctggatacacatttaccgactactacatgaattgggtacgacaagcccctggacaaagacttgaatggatgggagacattaacccttataacgacgacactacatacaatcataaatttaaaggaagagttacaattacaagagatacatccgcatcaaccgcctatatggaactttcctcattgagatctgaagacactgctgtttattactgtgcaagagaaactgccgttattactactaacgctatggattactggggtcaaggaaccactgttaccgtctctagt

SEQ ID NO: 384 - protein, 108 aa, Mus musculus
DIQMTQSPSSLSASVGDRVTITCSVSSTISSNHLHWFQQKPGKAPKSLIYGTSNLASGVPSRFSGSGSGTDFTLTISSLQPEDFATYYCQQWSSYPLTFGGGTKVEIK

SEQ ID NO: 385 - DNA, 324 bp, Mus musculus
gacatccagatgacccagtctccatcctccctctcagcatccgtaggcgatagagttacaataacatgcagcgtatcatcaactatatcatcaaatcatcttcattggttccaacagaaacccggcaaagcacctaaatcacttatatacggcacatcaaatctcgcatcaggcgttccttcaagattttcaggctctggctcaggcaccgactttactcttacaatatcctccctccaacccgaagacttcgcaacctattactgtcaacaatggtcctcatatccactcacatttggcggcggcacaaaagtagaaattaaa

SEQ ID NO: 386 - protein, 125 aa, Mus musculus
EVQLVQSGAEVKKPGASVKVSCKASDFNIKDFYLHWVRQAPGQGLEWIGRIDPENGDTLYDPKFQDKVTMTTDTSTSTAYMELRSLRSDDTAVYYCAREADYFHDGTSYWYFDVWGRGTLVTVSS

SEQ ID NO: 387 - DNA, 375 bp, Mus musculus
gaggtgcagctggtgcagtctggggctgaggtgaagaagcctggggcctcagtgaaggtctcctgcaaggcttctgacttcaacattaaagacttctatctacactgggtgcgacaggcccctggacaagggcttgagtggattggaaggattgatcctgagaatggtgatactttatatgacccgaagttccaggacaaggtcaccatgaccacagacacgtccaccagcacagcctacatggagctgaggagcctgagatctgacgacacggccgtgtattactgtgcgagagaggcggattatttccacgatggtacctcctactggtacttcgatgtctggggccgtggcaccctggtcaccgtctctagt

SEQ ID NO: 388 - protein, 106 aa, Mus musculus
DIQLTQSPSFLSASVGDRVTITCRASSSISYIHWYQQKPGKAPKLLIYATSNLASGVPSRFSGSGSGTEFTLTISSLQPEDFATYYCQQWSSDPLTFGGGTKVEIK

SEQ ID NO: 389 - DNA, 318 bp, Mus musculus
gacatccagttgacccagtctccatccttcctgtctgcatctgtaggagacagagtcaccatcacttgcagggccagctcaagtataagttacatacactggtatcagcaaaaaccagggaaagcccctaagctcctgatctatgccacatccaacctggcttctggggtcccatcaaggttcagcggcagtggatctgggacagaattcactctcacaatcagcagcctgcagcctgaagattttgcaacttattactgtcagcagtggagtagtgacccactcacgttcggcggagggaccaaggtggagatcaaa

SEQ ID NO: 390 - protein, 121 aa, Mus musculus
EVQLVQSGAEVKKPGASVKVSCKASGFDIKDYYIHWVRQAPGQGLEWIGRVDPDNGETEFAPKFPGKVTMTTDTSISTAYMELSRLRSDDTAVYYCAREDYDGTYTWFPYWGQGTLVTVSS

SEQ ID NO: 391 - DNA, 363 bp, Mus musculus
gaggtgcagctggtgcagtctggggctgaggtgaagaagcctggggcctcagtgaaggtctcctgcaaggcttctggattcgacattaaggactactatatacactgggtgcgacaggcccctggacaagggcttgagtggatcggaagggttgatcctgacaatggtgagactgaatttgccccgaagttcccgggcaaggtcaccatgaccacagacacgtccatcagcacagcctacatggagctgagcaggctgagatctgacgacacggccgtgtattactgtgcgagagaagactacgatggtacctacacctggtttccttattggggccaagggactctggtcaccgtctctagt

SEQ ID NO: 392 - protein, 448 aa, Artificial Sequence
  Synthetic Polypeptide
  MISC_FEATURE: Humanized Antibody Sequence
EVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 393 - protein, 446 aa, Artificial Sequence
  Synthetic Polypeptide
  MISC_FEATURE: Humanized Antibody Sequence
EVQLVQSGAEVKKPGASVKVSCKASGYTFTDYYMNWVRQAPGQRLEWMGDINPYNDDTTYNHKFKGRVTITRDTSASTAYMELSSLRSEDTAVYYCARETAVITTNAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 394 - protein, 450 aa, Artificial Sequence
  Synthetic Polypeptide
  MISC_FEATURE: Humanized Antibody Sequence
EVQLVQSGAEVKKPGASVKVSCKASDFNIKDFYLHWVRQAPGQGLEWIGRIDPENGDTLYDPKFQDKVTMTTDTSTSTAYMELRSLRSDDTAVYYCAREADYFHDGTSYWYFDVWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 395 - protein, 446 aa, Artificial Sequence
  Synthetic Polypeptide
  MISC_FEATURE: Humanized Antibody Sequence
EVQLVQSGAEVKKPGASVKVSCKASGFDIKDYYIHWVRQAPGQGLEWIGRVDPDNGETEFAPKFPGKVTMTTDTSISTAYMELSRLRSDDTAVYYCAREDYDGTYTWFPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 396 - protein, 445 aa, Artificial Sequence
  Synthetic Polypeptide
  MISC_FEATURE: Humanized Antibody Sequence
EVQLVQSGAEVKKPGSSVKVSCKASGFTFTDYIMHWVRQAPGQGLEWMGYINPYNDDTEYNEKFKGRVTITADKSTSTAYMELSSLRSEDTAVYYCARSIYYYDAPFAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 397 - protein, 213 aa, Homo sapiens
MQLPLALCLVCLLVHTAFRVVEGQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

SEQ ID NO: 398 - protein, 444 aa, Artificial
  Miscellaneous construct
QVQLVQSGAEVKKPGSSVKVSCKASGYTFTDYFLNWVRQAPGQGLEWMGTIYPYHDGTTYSQKFKGRVTITADKSTSTAYMELSSLRSEDTAVYYCAREEEDGQFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 399 - protein, 444 aa, Artificial
  Miscellaneous construct
QVQLVQSGAEVKKPGASVKVSCKVSGFPIKDTFQHWVRQAPGKGLEWMGWSDPEIGDTEYASKFQGRVTMTEDTSTDTAYMELSSLRSEDTAVYYCATGDTTYKFDFWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 400 - protein, 450 aa, Artificial
  Miscellaneous construct
EVQLVQSGAEVKKPGESLKISCKGSDFEIKDYYIHWVRQMPGKGLEWMGQIDAEDGETEYAPRFQGQVTISADKSISTAYLQWSSLKASDTAMYYCAREGYYYDGRDYWYFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 401 - protein, 214 aa, Artificial
  Miscellaneous construct
DIQMTQSPSSLSASVGDRVTITCSASQGIQWYLNWYQQKPGKAPKLLIYYTSSLHSGVPSRFSGSGSGTDFTLTISSLQPEDFATYYCQQHSKLPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 402 - protein, 214 aa, Artificial
  Miscellaneous construct
DIQMTQSPSSLSASVGDRVTITCKASQDVHTAVAWYQQKPGKAPKLLIYWASTRWTGVPSRFSGSGSGTDFTLTISSLQPEDFATYYCQQYSDYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 403 - protein, 213 aa, Artificial
  Miscellaneous construct
EIVLTQSPATLSLSPGERATLSCSASSSVSYIHWYQQKPGQAPRLLIYSTSELASGIPARFSGSGSGTDFTLTISSLEPEDFAVYYCQQLSHLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 404 - DNA, 1332 bp, Artificial
  Miscellaneous construct
caggtgcagctggtgcagtctggggctgaggtgaagaagcctgggtcctcagtgaaggtttcctgcaaggcatctggatacacattcactgactactttctgaactgggtgcgacaggcccctggacaagggcttgagtggatgggaactatttatccttaccatgatggtactacctactctcagaagttcaagggcagagtcaccattaccgcggacaaatccacgagcacagcctacatggagctgagcagcctgagatctgaggacacggccgtgtattactgtgcgagagaggaagaggatggtcagttcgactactggggccaaggaaccacggtcaccgtctcctcagcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggt

SEQ ID NO: 405 - DNA, 1332 bp, Artificial
  Miscellaneous construct
caggttcagctggtgcagtctggggctgaggtgaagaagcctggggcctcagtgaaggtctcctgcaaggtttccggcttccccattaaggacacctttcagcactgggtgcgacaggctcctggaaaagggcttgagtggatgggatggagcgatcctgagatcggtgatactgaatatgcctcgaagttccagggcagagtcaccatgaccgaggacacatctacagacacagcctacatggagctgagcagcctgagatctgaggacacggccgtgtattactgtgcaacaggcgacaccacatacaagtttgacttctgggggcaagggaccacggtcaccgtctcctcagcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggt

SEQ ID NO: 406 - DNA, 1350 bp, Artificial
  Miscellaneous construct
gaggtgcagctggtgcagtctggagcagaggtgaaaaagcccggggagtctctgaagatctcctgtaagggttctgacttcgagattaaagactactatatacattgggtgcgccagatgcccgggaaaggcctggagtggatggggcagattgatgctgaggatggtgaaactgaatatgccccgaggttccagggccaggtcaccatctcagccgacaagtccatcagcaccgcctacctgcagtggagcagcctgaaggcctcggacaccgccatgtattactgtgcgagagagggttattactacgatgggcgcgactactggtacttcgatgtctggggccaagggaccacggtcaccgtctcctcagcctccaccaagggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggt

SEQ ID NO: 407 - DNA, 642 bp, Artificial
  Miscellaneous construct
gacatccagatgacccagtctccatcctctctgtctgcatctgtaggagacagagtcaccatcacttgcagtgcaagtcagggcattcagtggtatttaaactggtatcagcagaaaccagggaaagcccctaagctcctgatctattacacatcaagtttacactcaggggtcccatcaaggttcagtggcagtggatctgggacagatttcactctcaccatcagcagtctgcaacctgaagattttgcaacttactactgtcagcagcatagtaaacttcctcggacgttcggcggagggaccaaggtggagatcaaacggactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 408 - DNA, 642 bp, Artificial
  Miscellaneous construct
gacatccagatgacccagtctccatcctccctgtctgcatctgtaggagacagagtcaccatcacttgcaaggccagtcaggatgtgcacactgctgtagcctggtatcagcagaaaccagggaaagcccctaagctcctgatctattgggcatccacccggtggactggagtcccatcaaggttcagtggcagtggatctgggacagatttcactctcaccatcagcagtctgcaacctgaagattttgcaacttactactgtcagcaatatagcgattatccgtggacgttcggcggagggaccaaggtggagatcaaacggactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 409 - DNA, 639 bp, Artificial
  Miscellaneous construct
gaaattgtgttgacacagtctccagccaccctgtctttgtctccaggggaaagagccaccctctcctgcagtgccagctcaagtgtaagttacatccactggtaccaacagaaacctggccaggctcccaggctcctcatctatagcacatccgagctggcttctggcatcccagccaggttcagtggcagtgggtctgggacagacttcactctcaccatcagcagcctagagcctgaagattttgcagtttattactgtcagcagcttagtcatctcccgctcacgttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 410 - protein, 118 aa, Artificial
  Miscellaneous construct
QVQLVQSGAEVKKPGSSVKVSCKASGYTFTDYFLNWVRQAPGQGLEWMGTIYPYHDGTTYSQKFKGRVTITADKSTSTAYMELSSLRSEDTAVYYCAREEEDGQFDYWGQGTTVTVSS

SEQ ID NO: 411 - protein, 118 aa, Artificial [sequence omitted]

SEQ ID NO: 412 - protein, 124 aa, Artificial
  Miscellaneous construct
EVQLVQSGAEVKKPGESLKISCKGSDFEIKDYYIHWVRQMPGKGLEWMGQIDAEDGETEYAPRFQGQVTISADKSISTAYLQWSSLKASDTAMYYCAREGYYYDGRDYWYFDVWGQGTTVTVSS

SEQ ID NO: 413 - protein, 107 aa, Artificial
  Miscellaneous construct
DIQMTQSPSSLSASVGDRVTITCSASQGIQWYLNWYQQKPGKAPKLLIYYTSSLHSGVPSRFSGSGSGTDFTLTISSLQPEDFATYYCQQHSKLPRTFGGGTKVEIK

SEQ ID NO: 414 - protein, 107 aa, Artificial [sequence omitted]

SEQ ID NO: 415 - protein, 106 aa, Artificial
  Miscellaneous construct
EIVLTQSPATLSLSPGERATLSCSASSSVSYIHWYQQKPGQAPRLLIYSTSELASGIPARFSGSGSGTDFTLTISSLEPEDFAVYYCQQLSHLPLTFGGGTKVEIK

SEQ ID NO: 416 - protein, 10 aa, Artificial
  Miscellaneous construct
GYTFTDYFLN

SEQ ID NO: 417 - protein, 17 aa, Artificial
  Miscellaneous construct
TIYPYHDGTTYSQKFKG

SEQ ID NO: 418 - protein, 9 aa, Artificial
  Miscellaneous construct
EEEDGQFDY

SEQ ID NO: 419 - protein, 11 aa, Artificial
  Miscellaneous construct
SASQGIQWYLN

SEQ ID NO: 420 - protein, 7 aa, Artificial
  Miscellaneous construct
YTSSLHS

SEQ ID NO: 421 - protein, 9 aa, Artificial
  Miscellaneous construct
QQHSKLPRT

SEQ ID NO: 422 - protein, 10 aa, Artificial
  Miscellaneous construct
GFPIKDTFQH

SEQ ID NO: 423 - protein, 17 aa, Artificial
  Miscellaneous construct
WSDPEIGDTEYASKFQG

SEQ ID NO: 424 - protein, 9 aa, Artificial
  Miscellaneous construct
GDTTYKFDF

SEQ ID NO: 425 - protein, 11 aa, Artificial
  Miscellaneous construct
KASQDVHTAVA

SEQ ID NO: 426 - protein, 7 aa, Artificial
  Miscellaneous construct
WASTRWT

SEQ ID NO: 427 - protein, 9 aa, Artificial
  Miscellaneous construct
QQYSDYPWT

SEQ ID NO: 428 - protein, 10 aa, Artificial
  Miscellaneous construct
DFEIKDYYIH

SEQ ID NO: 429 - protein, 17 aa, Artificial
  Miscellaneous construct
QIDAEDGETEYAPRFQG

SEQ ID NO: 430 - protein, 17 aa, Artificial
  Miscellaneous construct
QIDAEDGETEYAPRFQG

SEQ ID NO: 431 - protein, 17 aa, Artificial
  Miscellaneous construct
QIDAEDGETEYAPRFQG

SEQ ID NO: 432 - protein, 7 aa, Artificial
  Miscellaneous construct
STSELAS

SEQ ID NO: 433 - protein, 9 aa, Artificial
  Miscellaneous construct
QQLSHLPLT

SEQ ID NO: 434 - protein, 322 aa, Artificial
  Miscellaneous construct
GPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 435 - DNA, 970 bp, Artificial
  Miscellaneous construct
ggcccatcggtcttcccgctagcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccgctcagcagcgtggtgaccgtgccctccagcagcttgggcacgaagacctacacctgcaacgtagatcacaagcccagcaacaccaaggtggacaagagagttgagtccaaatatggtcccccatgcccaccctgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggaaagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggttga

SEQ ID NO: 436 - protein, 444 aa, Artificial
  Miscellaneous construct
EVQLQQSVAELVRPGASVKLSCTASGFNIKSTFMHWVKQRPDQGLEWIGWIDPENGDTEYASKFQGKATMTADTSSNTAYLQLSSLTSEDTAVYYCTTGESNYDFDFWGLGTTLTVSSAKTTPPSVYPLAPGTALKSNSMVTLGCLVKGYFPEPVTVTWNSGALSSGVHTFPAVLQSGLYTLTSSVTVPSSTWPSQTVTCNVAHPASSTKVDKKIVPRNCGGDCKPCICTGSEVSSVFIFPPKPKDVLTITLTPKVTCVVVDISQDDPEVHFSWFVDDVEVHTAQTRPPEEQFNSTFRSVSELPILHQDWLNGRTFRCKVTSAAFPSPIEKTISKPEGRTQVPHVYTMSPTKEEMTQNEVSITCMVKGFYPPDIYVEWQMNGQPQENYKNTPPTMDTDGSYFLYSKLNVKKEKWQQGNTFTCSVLHEGLHNHHTEKSLSHSPGK

SEQ ID NO: 437 - protein, 214 aa, Artificial
  Miscellaneous construct
DIVMTQSHKFMSTSVGDRVSITCKASQDVSTAVAWYQQKPGQSPKLLIYWASTRHTGVPDRFTGSGSGTDYTLTISDVQSEDLADYFCQQYSNYPWTFGGGTKLEIKRADAAPTVSIFPPSTEQLATGGASVVCLMNNFYPRDISVKWKIDGTERRDGVLDSVTDQDSKDSTYSMSSTLSLSKADYESHNLYTCEVVHKTSSSPVVKSFNRNEC

SEQ ID NO: 438 - protein, 450 aa, Artificial
  Miscellaneous construct
EVQLQQSGAEHVKPGASVKLSCTASDFNIKDYYIHWVKQRTAQGLEWIGRIDPEDGETEYAPRFQGKATIIADTSSNTAYLQLSSLTSEDTAVYYCAREGYYYDSRDYWYFDVWGTGTTVTVSSAKTTPPSVYPLAPGTALKSNSMVTLGCLVKGYFPEPVTVTWNSGALSSGVHTFPAVLQSGLYTLTSSVTVPSSTWPSQTVTCNVAHPASSTKVDKKIVPRNCGGDCKPCICTGSEVSSVFIFPPKPKDVLTITLTPKVTCVVVDISQDDPEVHFSWFVDDVEVHTAQTRPPEEQFNSTFRSVSELPILHQDWLNGRTFRCKVTSAAFPSPIEKTISKPEGRTQVPHVYTMSPTKEEMTQNEVSITCMVKGFYPPDIYVEWQMNGQPQENYKNTPPTMDTDGSYFLYSKLNVKKEKWQQGNTFTCSVLHEGLHNHHTEKSLSHSPGK

SEQ ID NO: 439 - protein, 213 aa, Artificial
  Miscellaneous construct
EIVLTQSPALMSASPGEKVTMTCSASSSVSYMHWFQQKPGTSPKLWIYSTSNLASGVPARFSGSGSGTSYSLTISSMEAEDAATYYCQQWSSNPLTFGAGTKLELKRADAAPTVSIFPPSTEQLATGGASVVCLMNNFYPRDISVKWKIDGTERRDGVLDSVTDQDSKDSTYSMSSTLSLSKADYESHNLYTCEVVHKTSSSPVVKSFNRNEC

SEQ ID NO: 440 - protein, 10 aa, Homo sapiens
GFTFSSYVMN

SEQ ID NO: 441 - protein, 10 aa, Homo sapiens
GFTFRSHWLS

SEQ ID NO: 442 - protein, 10 aa, Homo sapiens
GFTFSSYVMN

SEQ ID NO: 443 - protein, 10 aa, Homo sapiens
GFTFRSHWLS

SEQ ID NO: 444 - protein, 10 aa, Homo sapiens
GFTFRSHWLS

SEQ ID NO: 445 - protein, 10 aa, Homo sapiens
GFTFRSHWLS

SEQ ID NO: 446 - protein, 10 aa, Homo sapiens
GFTFRSHWLS

SEQ ID NO: 447 - protein, 10 aa, Homo sapiens
GFTFRSHWLS

SEQ ID NO: 448 - protein, 10 aa, Homo sapiens
GFTFRSHWLS

SEQ ID NO: 449 - protein, 10 aa, Homo sapiens
GFTFRSHWLS

SEQ ID NO: 450 - protein, 10 aa, Homo sapiens
GFTFRSHWLS

SEQ ID NO: 451 - protein, 20 aa, Homo sapiens
WVSFISGDSSNTYYADSVKG

SEQ ID NO: 452 - protein, 20 aa, Homo sapiens
WVSNINYDGSSTYYADSVKG

SEQ ID NO: 453 - protein, 20 aa, Homo sapiens
WVSFISGDSSNTYYADSVKG

SEQ ID NO: 454 - protein, 20 aa, Homo sapiens
WVSNINYDGSSTYYADSVKG

SEQ ID NO: 455 - protein, 19 aa, Homo sapiens
WVSVTGVHGDTYYADSVKG

SEQ ID NO: 456 - protein, 19 aa, Homo sapiens
WVSVIGNWGDTYYADSVKG

SEQ ID NO: 457 - protein, 19 aa, Homo sapiens
WVSVTTHQGYTYYADSVKG

SEQ ID NO: 458 - protein, 19 aa, Homo sapiens
WVSATNRYGYTYYADSVKG

SEQ ID NO: 459 - protein, 20 aa, Homo sapiens
WVSNINYDGSSTYYADSVKG

SEQ ID NO: 460 - protein, 19 aa, Homo sapiens
WVSVITPYGDTYYADSVKG

SEQ ID NO: 461 - protein, 19 aa, Homo sapiens
WVSVITPYGDTYYADSVKG

SEQ ID NO: 462 - protein, 15 aa, Homo sapiens
TFMHGHLGGGLSMDF

SEQ ID NO: 463 - protein, 8 aa, Homo sapiens
DTYLHFDY

SEQ ID NO: 464 - protein, 15 aa, Homo sapiens
TFMHGHLGGGLSMDF

SEQ ID NO: 465 - protein, 8 aa, Homo sapiens
DTYLHFDY

SEQ ID NO: 466 - protein, 8 aa, Homo sapiens
DTYLHFDY

SEQ ID NO: 467 - protein, 8 aa, Homo sapiens
DTYLHFDY

SEQ ID NO: 468 - protein, 8 aa, Homo sapiens
DTYLHFDY

SEQ ID NO: 469 - protein, 8 aa, Homo sapiens
DTYLHFDY

SEQ ID NO: 470 - protein, 8 aa, Homo sapiens
DTYLHFDY

SEQ ID NO: 471 - protein, 8 aa, Homo sapiens
DTYLHFDY

SEQ ID NO: 472 - protein, 8 aa, Homo sapiens
DTYLHFDY

SEQ ID NO: 473 - protein, 11 aa, Homo sapiens
SGDNIGSFYVH

SEQ ID NO: 474 - protein, 20 aa, Homo sapiens
WVSNINYDGSSTYYADSVKG

SEQ ID NO: 475 - protein, 20 aa, Homo sapiens
WVSNINYDGSSTYYADSVKG

SEQ ID NO: 476 - protein, 11 aa, Homo sapiens
SGDNIGSFYVH

SEQ ID NO: 477 - protein, 14 aa, Homo sapiens
TGTSSDVGDINDVS

SEQ ID NO: 478 - protein, 14 aa, Homo sapiens
TGTSSDVGDINDVS

SEQ ID NO: 479 - protein, 14 aa, Homo sapiens
TGTSSDVGDINDVS

SEQ ID NO: 480 - protein, 14 aa, Homo sapiens
TGTSSDVGDINDVS

SEQ ID NO: 481 - protein, 14 aa, Homo sapiens
TGTSSDVGDINDVS

SEQ ID NO: 482 - protein, 14 aa, Homo sapiens
TGTSSDVGDINDVS

SEQ ID NO: 483 - protein, 14 aa, Homo sapiens
TGTSSDVGDINDVS

SEQ ID NO: 484 - protein, 11 aa, Homo sapiens
LVIYDDNNRPS

SEQ ID NO: 485 - protein, 11 aa, Homo sapiens
LMIYDVNNRPS

SEQ ID NO: 486 - protein, 11 aa, Homo sapiens
LVIYDDNNRPS

SEQ ID NO: 487 - protein, 11 aa, Homo sapiens
LMIYDVNNRPS

SEQ ID NO: 488 - protein, 11 aa, Homo sapiens
LMIYDVNNRPS

SEQ ID NO: 489 - protein, 11 aa, Homo sapiens
LMIYDVNNRPS

SEQ ID NO: 490 - protein, 11 aa, Homo sapiens
LMIYDVNNRPS

SEQ ID NO: 491 - protein, 11 aa, Homo sapiens
LMIYDVNNRPS

SEQ ID NO: 492 - protein, 11 aa, Homo sapiens
LMIYDVNNRPS

SEQ ID NO: 493 - protein, 11 aa, Homo sapiens
LMIYDVNNRPS

SEQ ID NO: 494 - protein, 11 aa, Homo sapiens
LMIYDVNNRPS

SEQ ID NO: 495 - protein, 10 aa, Homo sapiens
GSWAGSSGSY

SEQ ID NO: 496 - protein, 10 aa, Homo sapiens
SSYGESLTSY

SEQ ID NO: 497 - protein, 10 aa, Homo sapiens
ASWTGVEPDY

SEQ ID NO: 498 - protein, 10 aa, Homo sapiens
QSYAGSYLSE

SEQ ID NO: 499 - protein, 10 aa, Homo sapiens
SSYGESLTSY

SEQ ID NO: 500 - protein, 10 aa, Homo sapiens
SSYGESLTSY

SEQ ID NO: 501 - protein, 10 aa, Homo sapiens
SSYGESLTSY

SEQ ID NO: 502 - protein, 10 aa, Homo sapiens
SSYGESLTSY

SEQ ID NO: 503 - protein, 10 aa, Homo sapiens
STYDGPGLSE

SEQ ID NO: 504 - protein, 10 aa, Homo sapiens
SSYGESLTSY

SEQ ID NO: 505 - protein, 10 aa, Homo sapiens
SSYGESLTSY

SEQ ID NO: 506 - protein, 124 aa, Homo sapiens
QVQLVESGGGLVQPGGSLRLSCAASGFTFSSYVMNWVRQAPGKGLEWVSFISGDSSNTYYADSVKGRFTISRDNSKNTLYLQMNSLRAEDTAVYYCARTFMHGHLGGGLSMDFWGQGTLVTVSS

SEQ ID NO: 507 - protein, 117 aa, Homo sapiens
QVQLVESGGGLVQPGGSLRLSCAASGFTFRSHWLSWVRQAPGKGLEWVSNINYDGSSTYYADSVKGRFTISRDNSKNTLYLQMNSLRAEDTAVYYCARDTYLHFDYWGQGTLVTVSS

SEQ ID NO: 508 - protein, 124 aa, Homo sapiens; identical to SEQ ID NO: 506

SEQ ID NO: 509 - protein, 117 aa, Homo sapiens; identical to SEQ ID NO: 507

SEQ ID NO: 510 - protein, 116 aa, Homo sapiens
QVQLVESGGGLVQPGGSLRLSCAASGFTFRSHWLSWVRQAPGKGLEWVSVTGVHGDTYYADSVKGRFTISRDNSKNTLYLQMNSLRAEDTAVYYCARDTYLHFDYWGQGTLVTVSS

SEQ ID NO: 511 - protein, 116 aa, Homo sapiens
QVQLVESGGGLVQPGGSLRLSCAASGFTFRSHWLSWVRQAPGKGLEWVSVIGNWGDTYYADSVKGRFTISRDNSKNTLYLQMNSLRAEDTAVYYCARDTYLHFDYWGQGTLVTVSS

SEQ ID NO: 512 - protein, 116 aa, Homo sapiens
QVQLVESGGGLVQPGGSLRLSCAASGFTFRSHWLSWVRQAPGKGLEWVSVTTHQGYTYYADSVKGRFTISRDNSKNTLYLQMNSLRAEDTAVYYCARDTYLHFDYWGQGTLVTVSS

SEQ ID NO: 513 - protein, 116 aa, Homo sapiens
QVQLVESGGGLVQPGGSLRLSCAASGFTFRSHWLSWVRQAPGKGLEWVSATNRYGYTYYADSVKGRFTISRDNSKNTLYLQMNSLRAEDTAVYYCARDTYLHFDYWGQGTLVTVSS

SEQ ID NO: 514 - protein, 117 aa, Homo sapiens; identical to SEQ ID NO: 507

SEQ ID NO: 515 - protein, 116 aa, Homo sapiens
QVQLVESGGGLVQPGGSLRLSCAASGFTFRSHWLSWVRQAPGKGLEWVSVITPYGDTYYADSVKGRFTISRDNSKNTLYLQMNSLRAEDTAVYYCARDTYLHFDYWGQGTLVTVSS

SEQ ID NO: 516 - protein, 116 aa, Homo sapiens; identical to SEQ ID NO: 515

SEQ ID NO: 517 - protein, 110 aa, Homo sapiens
DIELTQPPSVSVAPGQTARISCSGDNIGSFYVHWYQQKPGQAPVLVIYDDNNRPSGIPERFSGSNSGNTATLTISGTQAEDEADYYCGSWAGSSGSYVFGGRTKLTVLGQ

SEQ ID NO: 518 - protein, 113 aa, Homo sapiens
DIALTQPASVSGSPGQSITISCTGTSSDVGDINDVSWYQQHPGKAPKLMIYDVNNRPSGVSNRFSGSKSGNTASLTISGLQAEDEADYYCSSYGESLTSYVFGGGTKLTVLGQ

SEQ ID NO: 519 - protein, 110 aa, Homo sapiens
DIELTQPPSVSVAPGQTARISCSGDNIGSFYVHWYQQKPGQAPVLVIYDDNNRPSGIPERFSGSNSGNTATLTISGTQAEDEADYYCASWTGVEPDYVFGGGTKLTVLGQ

SEQ ID NO: 520 - protein, 113 aa, Homo sapiens
DIALTQPASVSGSPGQSITISCTGTSSDVGDINDVSWYQQHPGKAPKLMIYDVNNRPSGVSNRFSGSKSGNTASLTISGLQAEDEADYYCQSYAGSYLSEVFGGGTKLTVLGQ

SEQ ID NO: 521 - protein, 113 aa, Homo sapiens; identical to SEQ ID NO: 518

SEQ ID NO: 522 - protein, 113 aa, Homo sapiens; identical to SEQ ID NO: 518

SEQ ID NO: 523 - protein, 113 aa, Homo sapiens; identical to SEQ ID NO: 518

SEQ ID NO: 524 - protein, 113 aa, Homo sapiens; identical to SEQ ID NO: 518

SEQ ID NO: 525 - protein, 113 aa, Homo sapiens
DIALTQPASVSGSPGQSITISCTGTSSDVGDINDVSWYQQHPGKAPKLMIYDVNNRPSGVSNRFSGSKSGNTASLTISGLQAEDEADYYCSTYDGPGLSEVFGGGTKLTVLGQ

SEQ ID NO: 526 - protein, 113 aa, Homo sapiens; identical to SEQ ID NO: 518

SEQ ID NO: 527 - protein, 113 aa, Homo sapiens; identical to SEQ ID NO: 525

SEQ ID NO: 528 - DNA, 372 bp, Homo sapiens
caggtgcaattggtggaaagcggcggcggcctggtgcaaccgggcggcagcctgcgtctgagctgcgcggcctccggatttaccttttcttcttatgttatgaattgggtgcgccaagcccctgggaagggtctcgagtgggtgagctttatctctggtgattctagcaatacctattatgcggatagcgtgaaaggccgttttaccatttcacgtgataattcgaaaaacaccctgtatctgcaaatgaacagcctgcgtgcggaagatacggccgtgtattattgcgcgcgtacttttatgcatggtcatcttggtggtggtctttctatggatttttggggccaaggcaccctggtgacggttagctca

SEQ ID NO: 529 - DNA, 350 bp, Homo sapiens
caggtgcaattggtggaaagcggcggcggcctggtgcaaccgggcggcagcctgcgtctagctgcgcggcctccggatttacctttcgttctcattggctttcttgggtgcgccaagcccctgggaagggtctcgagtgggtgagcaatatcaattatgatggtagctctacctattatgcggatagcgtgaaaggccgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 530 - DNA, 372 bp, Homo sapiens; identical to SEQ ID NO: 528

SEQ ID NO: 531 - DNA, 351 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcaatatcaattatgatggtagctctacctattatgcggatagcgtgaaaggccgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 532 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgttactggtgttcatggtgatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 533 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgttattggtaattggggtgatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 534 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgttactactcatcagggttatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 535 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgctactaatcgttatggttatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 536 - DNA, 351 bp, Homo sapiens; identical to SEQ ID NO: 531

SEQ ID NO: 537 - DNA, 348 bp, Homo sapiens
caggtgcaattggtggaaagcggcggcggcctggtgcaaccgggcggcagcctgcgtctgagctgcgcggcctccggatttacctttcgttctcattggctttcttgggtgcgccaagcccctgggaagggtctcgagtgggtgagcgttattactccttatggtgatacttattatgctgattctgttaagggtcgttttaccatttcacgtgataattcgaaaaacaccctgtatctgcaaatgaacagcctgcgtgcggaagatacggccgtgtattattgcgcgcgtgatacttatcttcattttgattattggggccaaggcaccctggtgacggttagctca

SEQ ID NO: 538 - DNA, 348 bp, Homo sapiens; identical to SEQ ID NO: 537

SEQ ID NO: 539 - DNA, 330 bp, Homo sapiens
gatatcgaactgacccagccgccttcagtgagcgttgcaccaggtcagaccgcgcgtatctcgtgtagcggcgataatattggttctttttatgttcattggtaccagcagaaacccgggcaggcgccagttcttgtgatttatgatgataataatcgtccctcaggcatcccggaacgctttagcggatccaacagcggcaacaccgcgaccctgaccattagcggcactcaggcggaagacgaagcggattattattgcggttcttgggctggttcttctggttcttatgtgtttggcggccgcacgaagttaaccgttcttggccag

SEQ ID NO: 540 - DNA, 339 bp, Homo sapiens
gatatcgcactgacccagccagcttcagtgagcggctcaccaggtcagagcattaccatctcgtgtacgggtactagcagcgatgttggtgatattaatgatgtgtcttggtaccagcagcatcccgggaaggcgccgaaacttatgatttatgatgttaataatcgtccctcaggcgtgagcaaccgttttagcggatccaaaagcggcaacaccgcgagcctgaccattagcggcctgcaagcggaagacgaagcggattattattgctcttcttatggtgagtctcttacttcttatgtgtttggcggcggcacgaagttaaccgttcttggccag

SEQ ID NO: 541 - DNA, 330 bp, Homo sapiens
gatatcgaactgacccagccgccttcagtgagcgttgcaccaggtcagaccgcgcgtatctcgtgtagcggcgataatattggttctttttatgttcattggtaccagcagaaacccgggcaggcgccagttcttgtgatttatgatgataataatcgtccctcaggcatcccggaacgctttagcggatccaacagcggcaacaccgcgaccctgaccattagcggcactcaggcggaagacgaagcggattattattgcgcttcttggactggtgttgagcctgattatgtgtttggcggcggcacgaagttaaccgttcttggccag

SEQ ID NO: 542 - DNA, 339 bp, Homo sapiens
gatatcgcactgacccagccagcttcagtgagcggctcaccaggtcagagcattaccatctcgtgtacgggtactagcagcgatgttggtgatattaatgatgtgtcttggtaccagcagcatcccgggaaggcgccgaaacttatgatttatgatgttaataatcgtccctcaggcgtgagcaaccgttttagcggatccaaaagcggcaacaccgcgagcctgaccattagcggcctgcaagcggaagacgaagcggattattattgccagtcttatgctggttcttatctttctgaggtgtttggcggcggcacgaagttaaccgttcttggccag

SEQ ID NO: 543 - DNA, 339 bp, Homo sapiens; identical to SEQ ID NO: 540

SEQ ID NO: 544 - DNA, 339 bp, Homo sapiens; identical to SEQ ID NO: 540

SEQ ID NO: 545 - DNA, 339 bp, Homo sapiens; identical to SEQ ID NO: 540

SEQ ID NO: 546 - DNA, 339 bp, Homo sapiens; identical to SEQ ID NO: 540

SEQ ID NO: 547 - DNA, 339 bp, Homo sapiens
gatatcgcactgacccagccagcttcagtgagcggctcaccaggtcagagcattaccatctcgtgtacgggtactagcagcgatgttggtgatattaatgatgtgtcttggtaccagcagcatcccgggaaggcgccgaaacttatgatttatgatgttaataatcgtccctcaggcgtgagcaaccgttttagcggatccaaaagcggcaacaccgcgagcctgaccattagcggcctgcaagcggaagacgaagcggattattattgctctacttatgatggtcctggtctttctgaggtgtttggcggcggcacgaagttaaccgttcttggccag

SEQ ID NO: 548 - DNA, 339 bp, Homo sapiens; identical to SEQ ID NO: 540

SEQ ID NO: 549 - DNA, 339 bp, Homo sapiens; identical to SEQ ID NO: 547

SEQ ID NO: 550 - protein, 469 aa, Homo sapiens
MAWVWTLPFLMAAAQSVQAQVQLVESGGGLVQPGGSLRLSCAASGFTFSSYVMNWVRQAPGKGLEWVSFISGDSSNTYYADSVKGRFTISRDNSKNTLYLQMNSLRAEDTAVYYCARTFMHGHLGGGLSMDFWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 551 - protein, 462 aa, Homo sapiens
MAWVWTLPFLMAAAQSVQAQVQLVESGGGLVQPGGSLRLSCAASGFTFRSHWLSWVRQAPGKGLEWVSNINYDGSSTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 552 - protein, 469 aa, Homo sapiens; identical to SEQ ID NO: 550

SEQ ID NO: 553 - protein, 462 aa, Homo sapiens; identical to SEQ ID NO: 551

SEQ ID NO: 554 - protein, 461 aa, Homo sapiens
MAWVWTLPFLMAAAQSVQAQVQLVESGGGLVQPGGSLRLSCAASGFTFRSHWLSWVRQAPGKGLEWVSVTGVHGDTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 555 - protein, 461 aa, Homo sapiens
MAWVWTLPFLMAAAQSVQAQVQLVESGGGLVQPGGSLRLSCAASGFTFRSHWLSWVRQAPGKGLEWVSVIGNWGDTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 556 - protein, 461 aa, Homo sapiens
MAWVWTLPFLMAAAQSVQAQVQLVESGGGLVQPGGSLRLSCAASGFTFRSHWLSWVRQAPGKGLEWVSVTTHQGYTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 557 - protein, 465 aa, Homo sapiens
MKHLWFFLLLVAAPRWVLSQVQLVESGGGLVQPGGSLRLSCAASGFTFRSHWLSWVRQAPGKGLEWVSATNRYGYTYYADSVKGRFTISRDNSKNTLYLQMNSLRAEDTAVYYCARDTYLHFDYWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 558 - protein, 462 aa, Homo sapiens; identical to SEQ ID NO: 551

SEQ ID NO: 559 - protein, 461 aa, Homo sapiens
MAWVWTLPFLMAAAQSVQAQVQLVESGGGLVQPGGSLRLSCAASGFTFRSHWLSWVRQAPGKGLEWVSVITPYGDTYYADSVKGRFTISRDNSKNTLYLQMNSLRAEDTAVYYCARDTYLHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 560 - protein, 461 aa, Homo sapiens; identical to SEQ ID NO: 559

SEQ ID NO: 561 - protein, 130 aa, Homo sapiens
MSVLTQVLALLLLWLTGTRCDIELTQPPSVSVAPGQTARISCSGDNIGSFYVHWYQQKPGQAPVLVIYDDNNRPSGIPERFSGSNSGNTATLTISGTQAEDEADYYCGSWAGSSGSYVFGGRTKLTVLGQ

SEQ ID NO: 562 - protein, 237 aa, Homo sapiens
MSVLTQVLALLLLWLTGTRCDIALTQPASVSGSPGQSITISCTGTSSDVGDINDVSWYQQHPGKAPKLMIYDVNNRPSGVSNRFSGSKSGNTASLTISGLQAEDEADYYCSSYGESLTSYVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 563 - protein, 234 aa, Homo sapiens
MSVLTQVLALLLLWLTGTRCDIELTQPPSVSVAPGQTARISCSGDNIGSFYVHWYQQKPGQAPVLVIYDDNNRPSGIPERFSGSNSGNTATLTISGTQAEDEADYYCASWTGVEPDYVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 564 - protein, 237 aa, Homo sapiens
MSVLTQVLALLLLWLTGTRCDIALTQPASVSGSPGQSITISCTGTSSDVGDINDVSWYQQHPGKAPKLMIYDVNNRPSGVSNRFSGSKSGNTASLTISGLQAEDEADYYCQSYAGSYLSEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 565 - protein, 237 aa, Homo sapiens; identical to SEQ ID NO: 562

SEQ ID NO: 566 - protein, 237 aa, Homo sapiens; identical to SEQ ID NO: 562

SEQ ID NO: 567 - protein, 237 aa, Homo sapiens; identical to SEQ ID NO: 562

SEQ ID NO: 568 - protein, 237 aa, Homo sapiens; identical to SEQ ID NO: 562

SEQ ID NO: 569 - protein, 237 aa, Homo sapiens
MSVLTQVLALLLLWLTGTRCDIALTQPASVSGSPGQSITISCTGTSSDVGDINDVSWYQQHPGKAPKLMIYDVNNRPSGVSNRFSGSKSGNTASLTISGLQAEDEADYYCSTYDGPGLSEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 570 - protein, 237 aa, Homo sapiens; identical to SEQ ID NO: 562

SEQ ID NO: 571 - protein, 237 aa, Homo sapiens; identical to SEQ ID NO: 569

SEQ ID NO: 572 - DNA, 1410 bp, Homo sapiens
atggcttgggtgtggaccttgccattcctgatggcagctgcccaaagcgtgcaggcccaggtgcagctggtcgagtctggcggcggactggtgcagcctggcggcagcctgagactgagctgcgccgccagcggcttcaccttcagcagctacgtgatgaactgggtgcggcaggcccctggcaagggcctggagtgggtgtccttcatcagcggcgacagcagcaacacctactacgccgacagcgtgaagggccggttcaccatcagccgggacaacagcaagaacaccctgtacctgcagatgaacagcctgcgggccgaggacaccgccgtgtactactgcgcccggaccttcatgcacggccacctgggcggaggactgagcatggatttctggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 573 - DNA, 1389 bp, Homo sapiens
atggcttgggtgtggaccttgccattcctgatggcagctgcccaaggtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccaacatcaactacgacggcagcagcacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 574 - DNA, 1410 bp, Homo sapiens; identical to SEQ ID NO: 572

SEQ ID NO: 575 - DNA, 1389 bp, Homo sapiens
atggcttgggtgtggaccttgccattcctgatggcagctgcccaaggtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccaacatcaactacgacggcagcagcacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagagacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 576 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgtgaccggcgtgcacggcgacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 577 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgtgatcggcaactggggcgacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 578 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgtgaccacccaccagggctacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 579 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgccaccaacagatacggctacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 580 - DNA, 1389 bp, Homo sapiens; identical to SEQ ID NO: 573

SEQ ID NO: 581 - DNA, 1386 bp, Homo sapiens
atggcttgggtgtggaccttgccattcctgatggcagctgcccaaagtgtccaggcccaggtgcagctggtcgagagcggcggagggctggtgcagcctggcggcagcctgagactgagctgcgccgccagcggcttcaccttcagaagccactggctgtcctgggtgcggcaggcccctggcaagggcctggaatgggtgtccgtgatcaccccctacggcgacacctactacgccgacagcgtgaagggccggttcaccatcagccgggacaacagcaagaacaccctgtacctgcagatgaacagcctgcgggccgaggacaccgccgtgtactactgcgccagggacacctacctgcacttcgactactggggccagggcaccctggtcaccgtctcctcagcttccaccaagggcccatccgtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgacagtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 582 - DNA, 1386 bp, Homo sapiens; identical to SEQ ID NO: 581

SEQ ID NO: 583 - DNA, 393 bp, Homo sapiens
atgaaaaagacagctatcgcgattgcagtggcactggctggtttcgctaccgtagcgcaggccgatatcgaactgacccagccgccttcagtgagcgttgcaccaggtcagaccgcgcgtatctcgtgtagcggcgataatattggttctttttatgttcattggtaccagcagaaacccgggcaggcgccagttcttgtgatttatgatgataataatcgtccctcaggcatcccggaacgctttagcggatccaacagcggcaacaccgcgaccctgaccattagcggcactcaggcggaagacgaagcggattattattgcggttcttgggctggttcttctggttcttatgtgtttggcggccgcacgaagttaaccgttcttggccag

SEQ ID NO: 584 - DNA, 714 bp, Homo sapiens
atgagtgtgctcactcaggtcctggcgttgctgctgctgtggcttacaggtacgcgttgcgacatcgccctgacccagcccgccagcgtgagcggcagccctggccagagcatcaccatcagctgcaccggcaccagcagcgacgtgggcgacatcaacgacgtgagctggtatcagcagcaccccggcaaggcccccaagctgatgatctacgacgtgaacaaccggcccagcggcgtgagcaaccggttcagcggcagcaagagcggcaacaccgccagcctgaccatcagcggcctccaggccgaggacgaggccgactactactgcagcagctacggcgagagcctgaccagctacgtgtttggcggcggaaccaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggaaaagacagtggcccctacagaatgttcatag

SEQ ID NO: 585 - DNA, 705 bp, Homo sapiens
atgagtgtgctcactcaggtcctggcgttgctgctgctgtggcttacaggtacgcgttgcgacatcgagctgacccagccccccagcgtgagcgtggcccctggccagaccgcccggatcagctgcagcggcgacaacatcggcagcttctacgtgcactggtatcagcagaagcccggccaggcccccgtgctggtgatctacgacgacaacaaccggcccagcggcatccccgagcggttcagcggcagcaacagcggcaacaccgccaccctgaccatcagcggcacccaggccgaggacgaggccgactactactgcgccagctggaccggcgtggagcccgactacgtgtttggcggcggaacaaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggaaaagacagtggcccctacagaatgttcatag

SEQ ID NO: 586 - DNA, 714 bp, Homo sapiens
atgagtgtgctcactcaggtcctggcgttgctgctgctgtggcttacaggtacgcgttgcgacatcgccctgacccagcccgccagcgtgagcggcagccctggccagagcatcaccatcagctgcaccggcaccagcagcgacgtgggcgacatcaacgacgtgagctggtatcagcagcaccccggcaaggcccccaagctgatgatctacgacgtgaacaaccggcccagcggcgtgagcaaccggttcagcggcagcaagagcggcaacaccgccagcctgaccatcagcggcctccaggccgaggacgaggccgactactactgccagagctacgccggcagctacctgagcgaggtgttcggcggagggaccaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggaaaagacagtggcccctacagaatgttcatag

SEQ ID NO: 587 - DNA, 714 bp, Homo sapiens; identical to SEQ ID NO: 584

SEQ ID NO: 588 - DNA, 714 bp, Homo sapiens; identical to SEQ ID NO: 584

SEQ ID NO: 589 - DNA, 714 bp, Homo sapiens; identical to SEQ ID NO: 584

SEQ ID NO: 590 - DNA, 714 bp, Homo sapiens; identical to SEQ ID NO: 584

SEQ ID NO: 591 - DNA, 714 bp, Homo sapiens
atgagtgtgctcactcaggtcctggcgttgctgctgctgtggcttacaggtacgcgttgcgacatcgccctgacccagcccgccagcgtgagcggcagccctggccagagcatcaccatcagctgcaccggcaccagcagcgacgtgggcgacatcaacgacgtgagctggtatcagcagcaccccggcaaggcccccaagctgatgatctacgacgtgaacaaccggcccagcggcgtgagcaaccggttcagcggcagcaagagcggcaacaccgccagcctgaccatcagcggcctccaggccgaggacgaggccgactactactgcagcacctacgacggccctggcctgagcgaggtgttcggcggagggaccaagcttaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggaaaagacagtggcccctacagaatgttcatag

SEQ ID NO: 592 - DNA, 714 bp, Homo sapiens; identical to SEQ ID NO: 591

SEQ ID NO: 593 - DNA, 714 bp, Homo sapiens; identical to SEQ ID NO: 591

SEQ ID NO: 594 - protein, 213 aa, Homo sapiens; identical to SEQ ID NO: 397

SEQ ID NO: 595 - protein, 14 aa, Homo sapiens
ARLLNAIGRGKWWR

SEQ ID NO: 596 - protein, 15 aa, Homo sapiens
RLVASCKCKRLTRFH

SEQ ID NO: 597 - protein, 13 aa, Homo sapiens
GGGSGGGGSGGGG

SEQ ID NO: 598 - protein, 19 aa, Homo sapiens
GGGGSGGGGSGGGGSGGGG

SEQ ID NO: 599 - DNA, 21 bp, Artificial
  siRNA
taaattatcataaagtcctaa

SEQ ID NO: 600 - DNA, 21 bp, Artificial
  siRNA
aggactttatgataatttatt

SEQ ID NO: 601 - DNA, 21 bp, Artificial
  siRNA
atagtggttaaataactccag

SEQ ID NO: 602 - DNA, 21 bp, Artificial
  siRNA
ggagttatttaaccactattt

SEQ ID NO: 603 - DNA, 21 bp, Artificial
  siRNA
taaattctcgtgatgtgccat

SEQ ID NO: 604 - DNA, 21 bp, Artificial
  siRNA
ggcacatcacgagaatttatt

SEQ ID NO: 605 - DNA, 21 bp, Artificial
  siRNA
tttcttatagcacagctggtt

SEQ ID NO: 606 - DNA, 21 bp, Artificial
  siRNA
ccagctgtgctataagaaatt

SEQ ID NO: 607 - DNA, 21 bp, Artificial
  siRNA
tagacctttccatccacgctg

SEQ ID NO: 608 - DNA, 21 bp, Artificial
  siRNA
gcgtggatggaaaggtctatt

SEQ ID NO: 609 - DNA, 29 bp, Artificial
  siRNA
atgcagctcccactggccctgtgtcttgt

SEQ ID NO: 610 - DNA, 30 bp, Artificial
  siRNA
aatcaggccgagctggagaacgcctactag

SEQ ID NO: 611 - protein, 102 aa, Artificial Sequence
  KERE-class Nanobody
  misc_feature (31)..(35): CDR
  misc_feature (31)..(35): aa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
EVQLVESGGGLVQPGGSLRLSCAASGIPFSXXXXXWFRQAPGKQRDSVAXXXXXRFTISRDNAKNTVYLQMNSLKPEDTAVYRCYFXXXXXWGQGTQVTVSS

SEQ ID NO: 612 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
QVKLEESGGGLVQAGGSLRLSCVGSGRTFSXXXXXWFRLAPGKEREFVAXXXXXRFTISRDTASNRGYLHMNNLTPEDTAVYYCAAXXXXXWGQGTQVTVSS

SEQ ID NO: 613 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
AVQLVDSGGGLVQAGDSLKLSCALTGGAFTXXXXXWFRQTPGREREFVAXXXXXRFTISRDNAKNMVYLRMNSLIPEDAAVYSCAAXXXXXWGQGTLVTVSS

SEQ ID NO: 614 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
QVQLVESGGGLVEAGGSLRLSCTASESPFRXXXXXWFRQTSGQEREFVAXXXXXRFTISRDDAKNTVWLHGSTLKPEDTAVYYCAAXXXXXWGQGTQVTVSS

SEQ ID NO: 615 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
AVQLVESGGGLVQGGGSLRLACAASERIFDXXXXXWYRQGPGNERELVAXXXXXRFTISMDYTKQTVYLHMNSLRPEDTGLYYCKIXXXXXWGQGTQVTVSS

SEQ ID NO: 616 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
DVKFVESGGGLVQAGGSLRLSCVASGFNFDXXXXXWFRQAPGKEREEVAXXXXXRFTISSEKDKNSVYLQMNSLKPEDTALYICAGXXXXXWGRGTQVTVSS

SEQ ID NO: 617 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
QVRLAESGGGLVQSGGSLRLSCVASGSTYTXXXXXWYRQYPGKQRALVAXXXXXRFTIARDSTKDTFCLQMNNLKPEDTAVYYCYAXXXXXWGQGTQVTVSS

SEQ ID NO: 618 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
EVQLVESGGGLVQAGGSLRLSCAASGFTSDXXXXXWFRQAPGKPREGVSXXXXXRFTISTDNAKNTVHLLMNRVNAEDTALYYCAVXXXXXWGRGTRVTVSS

SEQ ID NO: 619 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
QVQLVESGGGLVQPGGSLRLSCQASGDISTXXXXXWYRQVPGKLREFVAXXXXXRFTISGDNAKRAIYLQMNNLKPDDTAVYYCNRXXXXXWGQGTQVTVSP

SEQ ID NO: 620 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
QVPVVESGGGLVQAGDSLRLFCAVPSFTSTXXXXXWFRQAPGKEREFVAXXXXXRFTISRNATKNTLTLRMDSLKPEDTAVYYCAAXXXXXWGQGTQVTVSS

SEQ ID NO: 621 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
EVQLVESGGGLVQAGDSLRLFCTVSGGTASXXXXXWFRQAPGEKREFVAXXXXXRFTIARENAGNMVYLQMNNLKPDDTALYTCAAXXXXXWGRGTQVTVSS

SEQ ID NO: 622 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
AVQLVESGGDSVQPGDSQTLSCAASGRTNSXXXXXWFRQAPGKERVFLAXXXXXRFTISRDSAKNMMYLQMNNLKPQDTAVYYCAAXXXXXWGQGTQVTVSS

SEQ ID NO: 623 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
AVQLVESGGGLVQAGGSLRLSCVVSGLTSSXXXXXWFRQTPWQERDFVAXXXXXRFTISRDNYKDTVLLEMNFLKPEDTAIYYCAAXXXXXWGQGTQVTVSS

SEQ ID NO: 624 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
AVQLVESGGGLVQAGASLRLSCATSTRTLDXXXXXWFRQAPGRDREFVAXXXXXRFTVSRDSAENTVALQMNSLKPEDTAVYYCAAXXXXXWGQGTRVTVSS

SEQ ID NO: 625 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
QVQLVESGGGLVQPGGSLRLSCTVSRLTAHXXXXXWFRQAPGKEREAVSXXXXXRFTISRDYAGNTAFLQMDSLKPEDTGVYYCATXXXXXWGQGTQVTVSS

SEQ ID NO: 626 - protein, 102 aa, Artificial Sequence
  KERE-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
EVQLVESGGELVQAGGSLKLSCTASGRNFVXXXXXWFRRAPGKEREFVAXXXXXRFTVSRDNGKNTAYLRMNSLKPEDTADYYCAVXXXXXLGSGTQVTVSS

SEQ ID NO: 627 - protein, 102 aa, Artificial Sequence
  GLEW-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
AVQLVESGGGLVQPGGSLRLSCAASGFTFSXXXXXWVRQAPGKVLEWVSXXXXXRFTISRDNAKNTLYLQMNSLKPEDTAVYYCVKXXXXXGSQGTQVTVSS

SEQ ID NO: 628 - protein, 102 aa, Artificial Sequence
  GLEW-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
EVQLVESGGGLVQPGGSLRLSCVCVSSGCTXXXXXWVRQAPGKAEEWVSXXXXXRFKISRDNAKKTLYLQMNSLGPEDTAMYYCQRXXXXXRGQGTQVTVSS

SEQ ID NO: 629 - protein, 102 aa, Artificial Sequence
  GLEW-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
EVQLVESGGGLALPGGSLTLSCVFSGSTFSXXXXXWVRHTPGKAEEWVSXXXXXRFTISRDNAKNTLYLEMNSLSPEDTAMYYCGRXXXXXRSKGIQVTVSS

SEQ ID NO: 630 - protein, 102 aa, Artificial Sequence
  P,R,S 103-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
AVQLVESGGGLVQAGGSLRLSCAASGRTFSXXXXXWFRQAPGKEREFVAXXXXXRFTISRDNAKNTVYLQMNSLKPEDTAVYYCAAXXXXXRGQGTQVTVSS

SEQ ID NO: 631 - protein, 102 aa, Artificial Sequence
  P,R,S 103-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid
DVQLVESGGDLVQPGGSLRLSCAASGFSFDXXXXXWLRQTPGKGLEWVGXXXXXRFTISRDNAKNMLYLHLNNLKSEDTAVYYCRRXXXXXLGQGTQVTVSS

SEQ ID NO: 632 - protein, 102 aa, Artificial Sequence; identical to SEQ ID NO: 628
  P,R,S 103-class Nanobody
  misc_feature (31)..(35): CDR
  misc_feature (31)..(35): Xaa is any amino acid
  misc_feature (50)..(54): CDR
  misc_feature (50)..(54): Xaa is any amino acid
  misc_feature (87)..(91): CDR
  misc_feature (87)..(91): Xaa is any amino acid

SEQ ID NO: 633 - protein, 30 aa, Artificial Sequence
  KERE-class Nanobody FW1 sequence
QVQRVESGGGLVQAGGSLRLSCAASGRTSS

SEQ ID NO: 634 - protein, 30 aa, Artificial Sequence
  KERE-class Nanobody FW1 sequence
QVQLVESGGGLVQTGDSLSLSCSASGRTFS

SEQ ID NO: 635 - protein, 30 aa, Artificial Sequence
  KERE-class Nanobody FW1 sequence
QVKLEESGGGLVQAGDSLRLSCAATGRAFG

SEQ ID NO: 636 - protein, 30 aa, Artificial Sequence
  KERE-class Nanobody FW1 sequence
AVQLVESGGGLVQPGESLGLSCVASGRDFV

SEQ ID NO: 637 - protein, 30 aa, Artificial Sequence
  KERE-class Nanobody FW1 sequence
EVQLVESGGGLVQAGGSLRLSCEVLGRTAG

SEQ ID NO: 638 - protein, 30 aa, Artificial Sequence
  KERE-class Nanobody FW1 sequence
QVQLVESGGGWVQPGGSLRLSCAASETILS

SEQ ID NO: 639 - protein, 30 aa, Artificial Sequence
  KERE-class Nanobody FW1 sequence
QVQLVESGGGTVQPGGSLNLSCVASGNTFN

SEQ ID NO: 640 - protein, 30 aa, Artificial Sequence
  KERE-class Nanobody FW1 sequence
EVQLVESGGGLAQPGGSLQLSCSAPGFTLD

SEQ ID NO: 641 - protein, 30 aa, Artificial Sequence
  KERE-class Nanobody FW1 sequence
AQELEESGGGLVQAGGSLRLSCAASGRTFN

SEQ ID NO: 642 - protein, 22 aa, Artificial Sequence
  KERE-class Nanobody FW1 sequence
VESGGGLVQPGGSLRLSCAASG

SEQ ID NO: 643 - protein, 22 aa, Artificial Sequence
  KERE-class Nanobody FW1 sequence
VDSGGGLVQAGDSLKLSCALTG

SEQ ID NO: 644 - protein, 22 aa, Artificial Sequence
  KERE-class Nanobody FW1 sequence
VDSGGGLVQAGDSLRLSCAASG

SEQ ID NO: 645 - protein, 22 aa, Artificial Sequence
  KERE-class Nanobody FW1 sequence
VDSGGGLVEAGGSLRLSCQVSE

SEQ ID NO: 646 - protein, 22 aa, Artificial Sequence
  KERE-class Nanobody FW1 sequence
QDSGGGSVQAGGSLKLSCAASG

SEQ ID NO: 647 - protein, 22 aa, Artificial Sequence
  KERE-class Nanobody FW1 sequence
VQSGGRLVQAGDSLRLSCAASE

SEQ ID NO: 648 - protein, 22 aa, Artificial Sequence
  KERE-class Nanobody FW1 sequence
VESGGTLVQSGDSLKLSCASST

SEQ ID NO: 649 - protein, 22 aa, Artificial Sequence
  KERE-class Nanobody FW1 sequence
MESGGDSVQSGGSLTLSCVASG

SEQ ID NO: 650 - protein, 22 aa, Artificial Sequence
  KERE-class Nanobody FW1 sequence
QASGGGLVQAGGSLRLSCSASV

SEQ ID NO: 651 - protein, 14 aa, Artificial Sequence
  KERE-class Nanobody FW2 sequence
WFRQAPGKEREFVA

SEQ ID NO: 652 - protein, 14 aa, Artificial Sequence
  KERE-class Nanobody FW2 sequence
WFRQTPGREREFVA

SEQ ID NO: 653 - protein, 14 aa, Artificial Sequence
  KERE-class Nanobody FW2 sequence
WYRQAPGKQREMVA

SEQ ID NO: 654 - protein, 14 aa, Artificial Sequence
  KERE-class Nanobody FW2 sequence
WYRQGPGKQRELVA

SEQ ID NO: 655 - protein, 14 aa, Artificial Sequence
  KERE-class Nanobody FW2 sequence
WIRQAPGKEREGVS

SEQ ID NO: 656 - protein, 14 aa, Artificial Sequence
  KERE-class Nanobody FW2 sequence
WFREAPGKEREGIS

SEQ ID NO: 657 - protein, 14 aa, Artificial Sequence
  KERE-class Nanobody FW2 sequence
WYRQAPGKERDLVA

SEQ ID NO: 658 - protein, 14 aa, Artificial Sequence
  KERE-class Nanobody FW2 sequence
WFRQAPGKQREEVS

SEQ ID NO: 659 - protein, 14 aa, Artificial Sequence
  KERE-class Nanobody FW2 sequence
WFRQPPGKVREFVG

SEQ ID NO: 660 - protein, 32 aa, Artificial Sequence
  KERE-class Nanobody FW3 sequence
RFTISRDNAKNTVYLQMNSLKPEDTAVYRCYF

SEQ ID NO: 661 - protein, 32 aa, Artificial Sequence
  KERE-class Nanobody FW3 sequence
RFAISRDNNKNTGYLQMNSLEPEDTAVYYCAA

SEQ ID NO: 662 - protein, 32 aa, Artificial Sequence
  KERE-class Nanobody FW3 sequence
RFTVARNNAKNTVNLEMNSLKPEDTAVYYCAA

SEQ ID NO: 663 - protein, 32 aa, Artificial Sequence
  KERE-class Nanobody FW3 sequence
RFTISRDIAKNTVDLLMNNLEPEDTAVYYCAA

SEQ ID NO: 664 - protein, 32 aa, Artificial Sequence
  KERE-class Nanobody FW3 sequence
RLTISRDNAVDTMYLQMNSLKPEDTAVYYCAA

SEQ ID NO: 665 - protein, 32 aa, Artificial Sequence
  KERE-class Nanobody FW3 sequence
RFTISRDNAKNTVYLQMDNVKPEDTAIYYCAA

SEQ ID NO: 666 - protein, 32 aa, Artificial Sequence
  KERE-class Nanobody FW3 sequence
RFTISKDSGKNTVYLQMTSLKPEDTAVYYCAT

SEQ ID NO: 667 - protein, 32 aa, Artificial Sequence
  KERE-class Nanobody FW3 sequence
RFTISRDSAKNMMYLQMNNLKPQDTAVYYCAA

SEQ ID NO: 668 - protein, 32 aa, Artificial Sequence
  KERE-class Nanobody FW3 sequence
RFTISRENDKSTVYLQLNSLKPEDTAVYYCAA

SEQ ID NO: 669 - protein, 32 aa, Artificial Sequence
  KERE-class Nanobody FW3 sequence
RFTISRDYAGNTAYLQMNSLKPEDTGVYYCAT

SEQ ID NO: 670 - protein, 11 aa, Artificial Sequence
  KERE-class Nanobody FW4 sequence
WGQGTQVTVSS

SEQ ID NO: 671 - protein, 11 aa, Artificial Sequence
  KERE-class Nanobody FW4 sequence
WGKGTLVTVSS

SEQ ID NO: 672 - protein, 11 aa, Artificial Sequence
  KERE-class Nanobody FW4 sequence
RGQGTRVTVSS

SEQ ID NO: 673 - protein, 11 aa, Artificial Sequence
  KERE-class Nanobody FW4 sequence
WGLGTQVTISS

SEQ ID NO: 674 - protein, 30 aa, Artificial Sequence
  GLEW-class Nanobody FW1 sequence
QVQLVESGGGLVQPGGSLRLSCAASGFTFS

SEQ ID NO: 675 - protein, 30 aa, Artificial Sequence
  GLEW-class Nanobody FW1 sequence
EVHLVESGGGLVRPGGSLRLSCAAFGFIFK

SEQ ID NO: 676 - protein, 30 aa, Artificial Sequence
  GLEW-class Nanobody FW1 sequence
QVKLEESGGGLAQPGGSLRLSCVASGFTFS

SEQ ID NO: 677 - protein, 30 aa, Artificial Sequence
  GLEW-class Nanobody FW1 sequence
EVQLVESGGGLVQPGGSLRLSCVCVSSGCT

SEQ ID NO: 678 - protein, 30 aa, Artificial Sequence
  GLEW-class Nanobody FW1 sequence
EVQLVESGGGLALPGGSLTLSCVFSGSTFS

SEQ ID NO: 679 - protein, 22 aa, Artificial Sequence
  GLEW-class Nanobody FW1 sequence
VESGGGLVQPGGSLRLSCAASG

SEQ ID NO: 680 - protein, 22 aa, Artificial Sequence
  GLEW-class Nanobody FW1 sequence
EESGGGLAQPGGSLRLSCVASG

SEQ ID NO: 681 - protein, 22 aa, Artificial Sequence
  GLEW-class Nanobody FW1 sequence
VESGGGLALPGGSLTLSCVFSG

SEQ ID NO: 682 - protein, 14 aa, Artificial Sequence
  GLEW-class Nanobody FW2 sequence
WVRQAPGKVLEWVS

SEQ ID NO: 683 - protein, 14 aa, Artificial Sequence
  GLEW-class Nanobody FW2 sequence
WVRRPPGKGLEWVS

SEQ ID NO: 684 - protein, 14 aa, Artificial Sequence
  GLEW-class Nanobody FW2 sequence
WVRQAPGMGLEWVS

SEQ ID NO: 685 - protein, 14 aa, Artificial Sequence
  GLEW-class Nanobody FW2 sequence
WVRQAPGKEPEWVS

SEQ ID NO: 686 - protein, 14 aa, Artificial Sequence
  GLEW-class Nanobody FW2 sequence
WVRQAPGKDQEWVS

SEQ ID NO: 687 - protein, 14 aa, Artificial Sequence
  GLEW-class Nanobody FW2 sequence
WVRQAPGKAEEWVS

SEQ ID NO: 688 - protein, 14 aa, Artificial Sequence
  GLEW-class Nanobody FW2 sequence
WVRQAPGKGLEWVA

SEQ ID NO: 689 - protein, 14 aa, Artificial Sequence
  GLEW-class Nanobody FW2 sequence
WVRQAPGRATEWVS

SEQ ID NO: 690 - protein, 32 aa, Artificial Sequence
  GLEW-class Nanobody FW3 sequence
RFTISRDNAKNTLYLQMNSLKPEDTAVYYCVK

SEQ ID NO: 691 - protein, 32 aa, Artificial Sequence
  GLEW-class Nanobody FW3 sequence
RFTISRDNARNTLYLQMDSLIPEDTALYYCAR

SEQ ID NO: 692 - protein, 32 aa, Artificial Sequence
  GLEW-class Nanobody FW3 sequence
RFTSSRDNAKSTLYLQMNDLKPEDTALYYCAR

SEQ ID NO: 693 - protein, 32 aa, Artificial Sequence
  GLEW-class Nanobody FW3 sequence
RFIISRDNAKNTLYLQMNSLGPEDTAMYYCQR

SEQ ID NO: 694 - protein, 32 aa, Artificial Sequence
  GLEW-class Nanobody FW3 sequence
RFTASRDNAKNTLYLQMNSLKSEDTARYYCAR

SEQ ID NO: 695 - protein, 32 aa, Artificial Sequence
  GLEW-class Nanobody FW3 sequence
RFTISRDNAKNTLYLQMDDLQSEDTAMYYCGR

SEQ ID NO: 696 - protein, 11 aa, Artificial Sequence
  GLEW-class Nanobody FW4 sequence
GSQGTQVTVSS

SEQ ID NO: 697 - protein, 11 aa, Artificial Sequence
  GLEW-class Nanobody FW4 sequence
LRGGTQVTVSS

SEQ ID NO: 698 - protein, 11 aa, Artificial Sequence
  GLEW-class Nanobody FW4 sequence
RGQGTLVTVSS

SEQ ID NO: 699 - protein, 11 aa, Artificial Sequence
  GLEW-class Nanobody FW4 sequence
RSRGIQVTVSS

SEQ ID NO: 700 - protein, 11 aa, Artificial Sequence
  GLEW-class Nanobody FW4 sequence
WGKGTQVTVSS

SEQ ID NO: 701 - protein, 11 aa, Artificial Sequence
  GLEW-class Nanobody FW4 sequence
WGQGTQVTVSS

SEQ ID NO: 702 - protein, 30 aa, Artificial Sequence
  P,R,S 103-class Nanobody FW1 sequence
AVQLVESGGGLVQAGGSLRLSCAASGRTFS

SEQ ID NO: 703 - protein, 30 aa, Artificial Sequence
  P,R,S 103-class Nanobody FW1 sequence
QVQLQESGGGMVQPGGSLRLSCAASGFDFG

SEQ ID NO: 704 - protein, 30 aa, Artificial Sequence; identical to SEQ ID NO: 675
  P,R,S 103-class Nanobody FW1 sequence

SEQ ID NO: 705 - protein, 30 aa, Artificial Sequence
  P,R,S 103-class Nanobody FW1 sequence
QVQLAESGGGLVQPGGSLKLSCAASRTIVS

SEQ ID NO: 706 - protein, 30 aa, Artificial Sequence
  P,R,S 103-class Nanobody FW1 sequence
QEHLVESGGGLVDIGGSLRLSCAASERIFS

SEQ ID NO: 707 - protein, 30 aa, Artificial Sequence; identical to SEQ ID NO: 676
  P,R,S 103-class Nanobody FW1 sequence

SEQ ID NO: 708 - protein, 30 aa, Artificial Sequence; identical to SEQ ID NO: 677
  P,R,S 103-class Nanobody FW1 sequence

SEQ ID NO: 709 - protein, 30 aa, Artificial Sequence; identical to SEQ ID NO: 678
  P,R,S 103-class Nanobody FW1 sequence

SEQ ID NO: 710 - protein, 22 aa, Artificial Sequence
  P,R,S 103-class Nanobody FW1 sequence
VESGGGLVQAGGSLRLSCAASG

SEQ ID NO: 711 - protein, 22 aa, Artificial Sequence
  P,R,S 103-class Nanobody FW1 sequence
AESGGGLVQPGGSLKLSCAASR

SEQ ID NO: 712 - protein, 14 aa, Artificial Sequence
  P,R,S 103-class Nanobody FW2 sequence
WFRQAPGKEREFVA

SEQ ID NO: 713 - protein, 14 aa, Artificial Sequence
  P,R,S 103-class Nanobody FW2 sequence
WVRQAPGKVLEWVS

SEQ ID NO: 714 - protein, 14 aa, Artificial Sequence
  P,R,S 103-class Nanobody FW2 sequence
WVRRPPGKGLEWVS

SEQ ID NO: 715 - protein, 14 aa, Artificial Sequence
  P,R,S 103-class Nanobody FW2 sequence
WIRQAPGKEREGVS

SEQ ID NO: 716 - protein, 14 aa, Artificial Sequence
  P,R,S 103-class Nanobody FW2 sequence
WVRQYPGKEPEWVS

SEQ ID NO: 717 - protein, 14 aa, Artificial Sequence
  P,R,S 103-class Nanobody FW2 sequence
WFRQPPGKEHEFVA

SEQ ID NO: 718 - protein, 14 aa, Artificial Sequence
  P,R,S 103-class Nanobody FW2 sequence
WYRQAPGKRTELVA

SEQ ID NO: 719 - protein, 14 aa, Artificial Sequence
  P,R,S 103-class Nanobody FW2 sequence
WLRQAPGQGLEWVS

SEQ ID NO: 720 - protein, 14 aa, Artificial Sequence
  P,R,S 103-class Nanobody FW2 sequence
WLRQTPGKGLEWVG

SEQ ID NO: 721 - protein, 14 aa, Artificial Sequence
  P,R,S 103-class Nanobody FW2 sequence
WVRQAPGKAEEFVS

SEQ ID NO: 722 - protein, 32 aa, Artificial Sequence
  P,R,S 103-class Nanobody FW3 sequence
RFTISRDNAKNTVYLQMNSLKPEDTAVYYCAA

SEQ ID NO: 723 - protein, 32 aa, Artificial Sequence; identical to SEQ ID NO: 691
  P,R,S 103-class Nanobody FW3 sequence

SEQ ID NO: 724 - protein, 32 aa, Artificial Sequence
  P,R,S 103-class Nanobody FW3 sequence
RFTISRDNAKNEMYLQMNNLKTEDTGVYWCGA

SEQ ID NO: 725 - protein, 32 aa, Artificial Sequence
  P,R,S 103-class Nanobody FW3 sequence
RFTISSDSNRNMIYLQMNNLKPEDTAVYYCAA

SEQ ID NO: 726 - protein, 32 aa, Artificial Sequence
  P,R,S 103-class Nanobody FW3 sequence
RFTISRDNAKNMLYLHLNNLKSEDTAVYYCRR

SEQ ID NO: 727 - protein, 32 aa, Artificial Sequence
  P,R,S 103-class Nanobody FW3 sequence
RFTISRDNAKKTVYLRLNSLNPEDTAVYSCNL

SEQ ID NO: 728 - protein, 32 aa, Artificial Sequence
  P,R,S 103-class Nanobody FW3 sequence
RFKISRDNAKKTLYLQMNSLGPEDTAMYYCQR

SEQ ID NO: 729 - protein, 32 aa, Artificial Sequence
  P,R,S 103-class Nanobody FW3 sequence
RFTVSRDNGKNTAYLRMNSLKPEDTADYYCAV

SEQ ID NO: 730 - protein, 11 aa, Artificial Sequence
  P,R,S 103-class Nanobody FW4 sequence
RGQGTQVTVSS

SEQ ID NO: 731 - protein, 11 aa, Artificial Sequence
  P,R,S 103-class Nanobody FW4 sequence
LRGGTQVTVSS

SEQ ID NO: 732 - protein, 11 aa, Artificial Sequence
  P,R,S 103-class Nanobody FW4 sequence
GNKGTLVTVSS

SEQ ID NO: 733 - protein, 11 aa, Artificial Sequence
  P,R,S 103-class Nanobody FW4 sequence
SSPGTQVTVSS

SEQ ID NO: 734 - protein, 11 aa, Artificial Sequence
  P,R,S 103-class Nanobody FW4 sequence
SSQGTLVTVSS

SEQ ID NO: 735 - protein, 11 aa, Artificial Sequence
  P,R,S 103-class Nanobody FW4 sequence
RSRGIQVTVSS

SEQ ID NO: 736 - protein, 30 aa, Artificial Sequence
  FR1 sequence
EVQLVESGGGLVQPGGSLRLSCAASGSIFS

SEQ ID NO: 737 - protein, 30 aa, Artificial Sequence
  FR1 sequence
EVQLVESGGGLVQAGDSLRLSCTATGRTSS

SEQ ID NO: 738 - protein, 30 aa, Artificial Sequence
  FR1 sequence
EVQLVESGGGLVQAGGSLRLSCATSGFTFS

SEQ ID NO: 739 - protein, 30 aa, Artificial Sequence
  FR1 sequence
KVQLVESGGGLVQAGGSLRLSCAASGRTFS

SEQ ID NO: 740 - protein, 30 aa, Artificial Sequence
  FR1 sequence
EVQLVESGGGLVQAGDSLRLSCAATGRTSS

SEQ ID NO: 741 - protein, 30 aa, Artificial Sequence
  FR1 sequence
EVQLVESGGGLVQAGGSLRLSCVASGRTLR

SEQ ID NO: 742 - protein, 30 aa, Artificial Sequence
  FR1 sequence
EVQLVESGGGLVQAGGSLRLTCAASGRTFS

SEQ ID NO: 743 - protein, 30 aa, Artificial Sequence
  FR1 sequence
EVQLVESGGGLVQAGGSLRLSCAASGLTFN

SEQ ID NO: 744 - protein, 30 aa, Artificial Sequence; identical to SEQ ID NO: 740
  FR1 sequence

SEQ ID NO: 745 - protein, 5 aa, Artificial Sequence
  CDR sequence
DNVMG

SEQ ID NO: 746 - protein, 5 aa, Artificial Sequence
  CDR sequence
IYNMD

SEQ ID NO: 747 - protein, 5 aa, Artificial Sequence
  CDR sequence
RFDMS

SEQ ID NO: 748 - protein, 5 aa, Artificial Sequence
  CDR sequence
SYFMG

SEQ ID NO: 749 - protein, 5 aa, Artificial Sequence
  CDR sequence
IYNMD

SEQ ID NO: 750 - protein, 5 aa, Artificial Sequence
  CDR sequence
RYVTG

SEQ ID NO: 751 - protein, 5 aa, Artificial Sequence
  CDR sequence
SFVIG

SEQ ID NO: 752 - protein, 5 aa, Artificial Sequence
  CDR sequence
QYTIT

SEQ ID NO: 753 - protein, 5 aa, Artificial Sequence
  CDR sequence
IYNMD

SEQ ID NO: 754 - protein, 14 aa, Artificial Sequence
  FR2 sequence
WYRQAPGKQRELVA

SEQ ID NO: 755 - protein, 14 aa, Artificial Sequence
  FR2 sequence
WFRQTPGKERELIA

SEQ ID NO: 756 - protein, 14 aa, Artificial Sequence
  FR2 sequence
WFRQAPGKQREFIA

SEQ ID NO: 757 - protein, 14 aa, Artificial Sequence
  FR2 sequence
WFRQAPGKEREVVA

SEQ ID NO: 758 - protein, 14 aa, Artificial Sequence
  FR2 sequence
WFLQAPGKERELIA

SEQ ID NO: 759 - protein, 14 aa, Artificial Sequence
  FR2 sequence
WFRQAPGKEREVVA

SEQ ID NO: 760 - protein, 14 aa, Artificial Sequence
  FR2 sequence
WFRQAPGKQREVVA

SEQ ID NO: 761 - protein, 14 aa, Artificial Sequence
  FR2 sequence
WFRQAPGKEREFVA

SEQ ID NO: 762 - protein, 14 aa, Artificial Sequence
  FR2 sequence
WFRQGSGKGRELIA

SEQ ID NO: 763 - protein, 16 aa, Artificial Sequence
  CDR sequence
TIWSSGHTNYADSVKG

SEQ ID NO: 764 - protein, 17 aa, Artificial Sequence
  CDR sequence
RLWWRSGSTYYADSVKG

SEQ ID NO: 765 - protein, 16 aa, Artificial Sequence
  CDR sequence
TIFSGGDTDYIDSVKG

SEQ ID NO: 766 - protein, 17 aa, Artificial Sequence
  CDR sequence
TIRWSDGSTYYEDSVKG

SEQ ID NO: 767 - protein, 17 aa, Artificial Sequence
  CDR sequence
RIWWRSGATYYADSVKG

SEQ ID NO: 768 - protein, 17 aa, Artificial Sequence
  CDR sequence
SISWSGESTYYADSVKG

SEQ ID NO: 769 - protein, 16 aa, Artificial Sequence
  CDR sequence
SITSGGSTYYEDSGKG

SEQ ID NO: 770 - protein, 17 aa, Artificial Sequence
  CDR sequence
AVSWSGSSESVSNSVKG

SEQ ID NO: 771 - protein, 17 aa, Artificial Sequence
  CDR sequence
RIWWRSGETYYADSVKG

SEQ ID NO: 772 - protein, 32 aa, Artificial Sequence
  FR3 sequence
RFTISRDNAKNTVYLQMNSLKPEDTAVYYCNL

SEQ ID NO: 773 - protein, 32 aa, Artificial Sequence
  FR3 sequence
RFTISRDNAKNTVYLQMNSLKPEDTSVYICTA

SEQ ID NO: 774 - protein, 32 aa, Artificial Sequence
  FR3 sequence
RFTISRDNAKNTVYLQMNSLKPEDTAVYYCCP

SEQ ID NO: 775 - protein, 32 aa, Artificial Sequence; identical to SEQ ID NO: 722
  FR3 sequence

SEQ ID NO: 776 - protein, 32 aa, Artificial Sequence
  FR3 sequence
RFTISRGNAKNTVYLQMNSLKPEDTGVYHCTA

SEQ ID NO: 777 - protein, 32 aa, Artificial Sequence
  FR3 sequence
RFAISRDNAKNAVYLQMNSLNLEDTGVYYCAE

SEQ ID NO: 778 - protein, 32 aa, Artificial Sequence
  FR3 sequence
RFTISRDNAKNRVYLQMNSLRPEDTAVYYCAA

SEQ ID NO: 779 - protein, 32 aa, Artificial Sequence
  FR3 sequence
RFTISRDNAKNTAYLAMNSLKPEDTAVYYCAA

SEQ ID NO: 780 - protein, 32 aa, Artificial Sequence
  FR3 sequence
RFTISRDNAKNTVYLQMNSLKPEDTNVYHCAA

SEQ ID NO: 781 - protein, 12 aa, Artificial Sequence
  CDR sequence
GTIVTGTWRSDY

SEQ ID NO: 782 - protein, 10 aa, Artificial Sequence
  CDR sequence
GDTGGAAYGY

SEQ ID NO: 783 - protein, 6 aa, Artificial Sequence
  CDR sequence
LGIEYA

SEQ ID NO: 784 - protein, 9 aa, Artificial Sequence
  CDR sequence
AKGIGVYGY

SEQ ID NO: 785 - protein, 10 aa, Artificial Sequence
  CDR sequence
GVTGGAAYGY

SEQ ID NO: 786 - protein, 9 aa, Artificial Sequence
  CDR sequence
AELPGTYDY

SEQ ID NO: 787 - protein, 9 aa, Artificial Sequence
  CDR sequence
AEPAGVYDV

SEQ ID NO: 788 - protein, 15 aa, Artificial Sequence
  CDR sequence
DRRGLASTRAADYDY

SEQ ID NO: 789 - protein, 10 aa, Artificial Sequence
  CDR sequence
GDTGGASYGY

SEQ ID NO: 790 - protein, 11 aa, Artificial Sequence
  FR4 sequence
WGQGTQVTVSS

SEQ ID NO: 791 - protein, 11 aa, Artificial Sequence
  FR4 sequence
WGQGTQVTVSS

SEQ ID NO: 792 - protein, 11 aa, Artificial Sequence
  FR4 sequence
WGQGTQVTVSS

SEQ ID NO: 793 - protein, 11 aa, Artificial Sequence
  FR4 sequence
WGQGTQVTVSS

SEQ ID NO: 794 - protein, 11 aa, Artificial Sequence
  FR4 sequence
WGQGTQVTVSS

SEQ ID NO: 795 - protein, 11 aa, Artificial Sequence
  FR4 sequence
WGQGTQVTVSS

SEQ ID NO: 796 - protein, 11 aa, Artificial Sequence
  FR4 sequence
WGQGTQVTVSS

SEQ ID NO: 797 - protein, 11 aa, Artificial Sequence
  FR4 sequence
WGQGTQVTVSS

SEQ ID NO: 798 - protein, 11 aa, Artificial Sequence
  FR4 sequence
WGQGTQVTVSS

SEQ ID NO: 799 - protein, 120 aa, Artificial Sequence
  Nanobody
EVQLVESGGGLVQPGGSLRLSCAASGSIFSDNVMGWYRQAPGKQRELVATIWSSGHTNYADSVKGRFTISRDNAKNTVYLQMNSLKPEDTAVYYCNLGTIVTGTWRSDYWGQGTQVTVSS

SEQ ID NO: 800 - protein, 119 aa, Artificial Sequence
  Nanobody
EVQLVESGGGLVQAGDSLRLSCTATGRTSSIYNMDWFRQTPGKERELIARLWWRSGSTYYADSVKGRFTISRDNAKNTVYLQMNSLKPEDTSVYICTAGDTGGAAYGYWGQGTQVTVSS

SEQ ID NO: 801 - protein, 114 aa, Artificial Sequence
  Nanobody
EVQLVESGGGLVQAGGSLRLSCATSGFTFSRFDMSWFRQAPGKQREFIATIFSGGDTDYIDSVKGRFTISRDNAKNTVYLQMNSLKPEDTAVYYCCPLGIEYAWGQGTQVTVSS

SEQ ID NO: 802 - protein, 118 aa, Artificial Sequence
  Nanobody
KVQLVESGGGLVQAGGSLRLSCAASGRTFSSYFMGWFRQAPGKEREVVATIRWSDGSTYYEDSVKGRFTISRDNAKNTVYLQMNSLKPEDTAVYYCAAAKGIGVYGYWGQGTQVTVSS

SEQ ID NO: 803 - protein, 119 aa, Artificial Sequence
  Nanobody
EVQLVESGGGLVQAGDSLRLSCAATGRTSSIYNMDWFLQAPGKERELIARIWWRSGATYYADSVKGRFTISRGNAKNTVYLQMNSLKPEDTGVYHCTAGVTGGAAYGYWGQGTQVTVSS

SEQ ID NO: 804 - protein, 118 aa, Artificial Sequence
  Nanobody
EVQLVESGGGLVQAGGSLRLSCVASGRTLRRYVTGWFRQAPGKEREVVASISWSGESTYYADSVKGRFAISRDNAKNAVYLQMNSLNLEDTGVYYCAEAELPGTYDYWGQGTQVTVSS

SEQ ID NO: 805 - protein, 117 aa, Artificial Sequence
  Nanobody
EVQLVESGGGLVQAGGSLRLTCAASGRTFSSFVIGWFRQAPGKQREVVASITSGGSTYYEDSGKGRFTISRDNAKNRVYLQMNSLRPEDTAVYYCAAAEPAGVYDVWGQGTQVTVSS

SEQ ID NO: 806 - protein, 124 aa, Artificial Sequence
  Nanobody
EVQLVESGGGLVQAGGSLRLSCAASGLTFNQYTITWFRQAPGKEREFVAAVSWSGSSESVSNSVKGRFTISRDNAKNTAYLAMNSLKPEDTAVYYCAADRRGLASTRAADYDYWGQGTQVTVSS

SEQ ID NO: 807 - protein, 119 aa, Artificial Sequence
  Nanobody
EVQLVESGGGLVQAGDSLRLSCAATGRTSSIYNMDWFRQGSGKGRELIARIWWRSGETYYADSVKGRFTISRDNAKNTVYLQMNSLKPEDTNVYHCAAGDTGGASYGYWGQGTQVTVSS

SEQ ID NO: 808 - protein, 213 aa, Homo sapiens
MQLPLALCLVCLLVHTAFRVVEGQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQTVQLLCPGGEAPRARKVRLVASCKCKRLTRFHNQSELKDFGTEAARPQKGRKPRPRARSAKANQAELENAY

SEQ ID NO: 809 - protein, 213 aa, Artificial Sequence
  Recombinant sclerostin
MPLLLLLPLLWAGALAHHHHHHHQGWQAFKNDATEIIPELGEYPEPPPELENNKTMNRAENGGRPPHHPFETKDVSEYSCRELHFTRYVTDGPCRSAKPVTELVCSGQCGPARLLPNAIGRGKWWRPSGPDFRCIPDRYRAQRVQLLCPGGEAPRARKVRLVASCKCKRLTRFHNQSELKDFGTEAARPQKGRKPRPRARSAKANQAELENAY

What is claimed is:

1. A method for increasing alveolar bone height in a subject suffering from alveolar bone loss comprising administering to the subject an anti-sclerostin antibody in an amount effective to decrease the distance between the cement-enamel junction and the alveolar bone crest, at a dose from about 5 mg to about 1,000 mg per week, and wherein the anti-sclerostin antibody comprises a CDR-H1 of SEQ ID NO:245, a CDR-H2 of SEQ ID NO:246, a CDR-H3 of SEQ ID NO:247, a CDR-L1 of SEQ ID NO:78, a CDR-L2 of SEQ ID NO:79, and a CDR-L3 of SEQ ID NO:80.

2. The method of claim 1, wherein the distance between the cement-enamel junction and the alveolar bone crest is decreased by at least 10% compared to the pre-treatment distance by six weeks after initiation of treatment.

3. The method of claim 1, wherein the alveolar bone height is increased by at least 10% compared to the pre-treatment alveolar bone height by six weeks after initiation of treatment.

4. The method of claim 1, wherein the alveolar bone height of the subject is increased by at least 1 mm compared to pre-treatment alveolar bone height by six weeks after initiation of treatment.

5. The method of claim 1, wherein the alveolar bone density of the subject is increased by at least 10% compared to pre-treatment alveolar bone density by six weeks after initiation of treatment.

6. The method of claim 1, wherein the alveolar bone volume fraction is increased by at least 10% compared to pre-treatment bone volume fraction by six weeks after initiation of treatment.

7. The method of claim 1, wherein the antibody is administered in an amount from about 120-270 mg.

8. The method of claim 1, wherein the anti-sclerostin antibody is administered twice a week.

9. The method of claim 1, wherein the anti-sclerostin antibody is administered locally to diseased gingival area or diseased periodontal pocket of the subject.

10. The method of claim 1, wherein the method comprises administering a standard of care therapeutic selected from the group consisting of doxycycline hyclate (Periostat®) or chemically modified tetracycline-3 (CMT-3) prior to administering the anti-sclerostin antibody.

11. The method of claim 1, further comprising administering a second bone-enhancing therapeutic selected from the group consisting of parathyroid hormone, teriparatide, a bisphosphonate, a receptor activator of nuclear factor kappa-B ligand (RANKL) antibody and a dickkopf-1 (DKK-1) antibody.

12. The method of claim 11, wherein the second bone-enhancing therapeutic is administered after the treatment period with the anti-sclerostin antibody has ended.

13. The method of claim 1, optionally comprising administering the anti-sclerostin antibody for a second period of time in an amount sufficient to maintain alveolar bone.

14. The method of claim 1, wherein the anti-sclerostin antibody is an immunoglobulin comprising a heavy chain and a light chain.

15. The method of claim 1, wherein the anti-sclerostin antibody is an antibody or fragment thereof that demonstrates a binding affinity for sclerostin of SEQ ID NO: 1 of less than or equal to $1 \times 10^{-9}$ M.

16. The method of claim 1, wherein anti-sclerostin antibody comprises heavy chains comprising SEQ ID NO: 378 and light chains comprising SEQ ID NO 376.

* * * * *